United States Patent 10,724,096 (METHODS AND COMPOSITIONS FOR INHIBITING AND TREATING NEUROLOGICAL CONDITIONS) - sequence listing, part 121

SEQ ID NO: 2233 - DNA, 733316 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgc

SEQ ID NO: 2234 - DNA, 52831 bp, Homo sapiens
gttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgctgggtgcaaggaaggtgatctctttaaattgtcctttttattaactgctcaaaacctcccccaccaagtcactgttccccatcccccactgtctcaagtgggagtattttctgctgctaacgacttccatggaacaccctgaatattttctctccatctctgtggaagcagggcccctcctccattgttcttctgaggagcacatgagcctcatctgatttgccatctctgaaatccaattatcagcgtgcgtatattaagctcccacacatgctggcctggcacaaaggctggctgggccatctgagggccccaggcctccccagaggaagaggggaacatccaccctttgcgtaaacccagagccccagggtggatgaggatggagcaccatggggatgaagtggatctgcccctgtgccccccacgtcccgtaagcccgcgtgtgacggggaggaccaccccccacatcccgtaagccctcctgtgatagggaggaccgccccccacatcccgtaagcctgcgtgtgacggggaggactaccccccacatcccataagcccacgtgtgacagggaggaccacccccacatcccgtaagcctgcgtgtgacggggaggaccgccccccacatcccgtaagcctgcgtgtgacagggaggaccaccccccacatcccgtaagcccacgtgtgacagggaggaccacccccacatcccgtaagcctgcgtgtgacggggaggactaccccccacatcccgtaagcctgcgtgtgacagggaggaccaccctccacatcccataagcccgcgtgtgacggggaggaccacccccacatcccgtaagcctgcgtgtgacggggaggaccaccccccacatcccgtaagcccacgtgtgacagggaggaccacccccacatcccgtaagccctcgtgtgacggggaggaccgccccccacatcccgtaagcctgcgtgtgacagggaggaccaccctccacatcccgtaagcctgcgtgtgacgggaaggaccacccccacatcttacacctccgtggggctcacaggcagggaggacacacctgcctgagggagtcaccagcccctccctccacaaagcctcactgtctccaaggtcccaagtcagaatgcaaacttggagaagccgggcccctcacagccagagcttcagacagccgggccccagcaccagggcggcccaaaccagccctggagccagagaagaggaaggggctgatggaaccacgtgttgtctctcctctggggccctgaggggcagcggctgaggttgaggatggaagacagcatgggccaccgaggctatgctctgggctgcacgttcttggcacccatgcgattccaagtctgtgtctgtgtagagccgcttggggagcacctgcaggcccagcgtccctggagatacctctgcccctgcgggcctcctccttctacccctgcgggcctccagttctgggcttggcaaacttcccacgggagaccaggaggccagagagaagcccccaggacagggctgtggccctgggggcacggtccctgccatgatggggacgtccctggggcaggggcaggaggcttggggaaggatgaagctgcctgtggcaccaagcagacgcgcctgcctgcaggagtgaccactgcagggtcgctggcaaaagctcccgccatctgaccctggggaccacatcttcccccgtcacagaaatggaaaagatgtttccaggccagacctccagcaggggccttgtgttcccagggagcagggccccagctttatattcgaagtgagaggggagactgaggtatgaggtgcagggatccctccacgaggagatgttgtcaggccctggtcatctccactgagcccaacagctgctgtgtcccgggcatggctgaaggtggctgacccaagcaggccctgaacgcgagggacccccagcagccccacaggcccctggaccccagggacccccagacgcaccatctccatgagtgctggttcctgctccctcctcggggtccctggtgcaggtccccaggtgagctgagaaggtcgtggctctcgggccccgctcaaacctgagccctctctgtcctggacgtgagggcagagtgtgcacaggcctcccccggatgtccctctaaggaagatcttttcctgacaacgtcatgtgtcgggagagggtcctcttgtggaatatctgaagacctgtgtcatgtgtgacttcaaaactcacgactccccacgttcaccctgcccttccccgcacagaaacacatcacggtgcctgctttaatctgcagcttcatcgggctgggcctgacacagctctctctgcagaggctgctgttaactcacgcaaaaggacctgccagtcagccgggcatgtgggcagtgcctcccacccagaaaggaagcccacgtttatcaggaccagggttctcaactgtgtccccgggggcacacggcacgtccaggcaggagacacgggacacgtccggagagtttgggttgtcacaccggcggctctgatatgccgcaggcagaggccagggcccaccagcaccctcagcacctagggtgccccagcacagcggttggccagccctgaatgcctacagtgccgaggtaagaaacgtggcccggtctgtttcacccatggccacagcacagagcttcatggcacagaaggcggtcatgcccaggagtggaaatcggacaggcaggcaggggccactgtcctgctcgccccccaccatggcctctccctccgtcatctccaaggtcaatagcatcatgtcaggatgaaccctatgatgtctccacgtctgcgggtaaaatggggttggattttggcagatccatatggctccacctaaataacctggccatgcccacaggatgtccaccagcagacaaacgcaggagcctccaccactgcagcggggagctgcccaggcctgtgcggggccagccccggggtcagaagagccagctgccggcagagcatggtggcgggtcaccagggccacctggcgcggtccccggccatacttgcagggaggttgtgccctgacggcagggttgtcactgccccccacctcccatccctaatccagaaggtgaggcggctgcaagacctcatcccctccgaccccagccccatcctgtccatcccactgcctgtgaccagcgcgtccaactccagcaggtgatgctggccctacctgaaggggcagagggtaggacgagcaggtcgggacgggctcgggcgtcaggcggaagcctgcgtaggccaggatctgctgggcggggttgtagagggtctgtggtgggacggctgggccataggccagctgggacagaggcacctgccatggagaggagacgggtggtcggcgtgtaccccctagtggagggaagggctgtccagccttcctagaaagcccagcaccctcgacccccgactctcaggctggaactaaccccggcccggcgtgcgtttatacccaggctggagctaacgccggcccggcgtgcgtttatacccaggctggagctaaccccggcccggcgtgcgtttatacccaggctggagctaaccccggcccggcgtgcgtttatacccaggctggagctaaccccggcccggcgtgcgtttatacccaggctggagctaaccccggcccggcgtagctttacactgaggttctctacatcttggtcccagggccccgccacctgctagtcacactgggtgaccgctcggctcgggctctcttttacttttttgattttttggggggggagaaaaaagcactggtttccttctctccgggccccaaagtctgctttttcggcacagaagggtgcaggtggggagggccctctcagcaccgggctgatggctctcgcttccccaagcctgtgccccaaccagcgtggggtttctggggaatgcgaacaaaaccaaagtctcctgagctcccgtccacactttcactgactcactcaggcagttaaaattctccaaagaaggtgctggctccaactcaggccccggccggcctcatcccctacagagggaggggcccatggctcacacaagcttcagggcttccccgggccagaaacgcggggactgggccgagggcacccgggcttcgcctccctccccaccttcacacaggtgcccctccaccttccccagcccccacccccaggttcagcagcaccctggaggaagccaggggaagatggcaaaggcggggaagccaggccagagccgctgcgaggggctggccacggtgacgacccggggacacggtgacaacccggggacacggtgaaaaccccgggacagggtgatgaccccaggcctgaggtgtcctcagacaacggtgctgcccgcacccctggggctgggagggagccccctgcccagcgggcactggaaggtgggaaggggcagggccttctgggcagctggtccttggtccacatgtgcaggaggccgtgcttctgcctcagaccctgcagagagcaggggggcagccgaggtgggcctgggaggttggatgggcatggagggtcgtgctccgtgagggaggggcaggagatttgcagttctgacaggtagaggggtggggaggcctctgagctggcggtggcctgaggatggggccggggcgagtgcacagaaagcagagaacacgggggccacggagtcacacgcggaggaggcccctgagaggctggctcagccgcccgcccttgccggcacgttaagtgcctcccacgcacccatcacaagtaatttgccctcgtctacgaagggcacgtccagcttggaatgttaaggaatgaaggaagcatcttcattccttaacaaaatgtttaaatggcaaaatcagttaaactcacaagagggcctgcttggtgggtgtgaaggttagcaagtcctctccttgctctgcagccctgagctttgggttcgaggaagacttcctggagccggtgtggctctgcattgcgggctggccctggaggtatcacctgttcctgatcctgcactccagcattttatcacgggctttaatgaacacacgagccccttccggaaaaccctggacaccccgggcctgtgtggcgagcatggcgcctgcaccagacaagcgtttctgtgtcctgtctacaatccggctgcagttcctcctgggacggccgctgagaggagacactgagctgccgaggcagagaagcttgcaccgaggagacgccaaaggcgcccggagcccgcgagatcccggcagagacccttcccgaccccagactcccgctcccaccgcaggggccggccggctgtcaccacagagcaaggacccctgggaggtgcctgtcttgtgttggtgtgcgggcgtctgggggcccagggtggggcttggggggccactgggtggggagccagagggctggacctcgggatgccagggtcactctcagcttcaccagttttgtctggaagcacaaaagtgttgagaaaaggaggagctgagaagcagatggcaggagggttcccagctgagctaatttttagtcatggacagcctctgggacgaatagggcatggagaagccgctcaggagtgttttcgctgcctcgctgggccgggtctggcctgcatgatgtgcgtctgcctggtgctgccaggcctcctcatgtgggtgcaagagggggcgcccctcgtccctgggctgccgtttggatactctgggggttggggctccctcactcctggctgcccatcccttacagcttctctgcaagttcagggggcggggtttgctggccgcacaccacgagaacatctggtttgaaacaggcgccaggagagggcagaggagggagaagagagaggacatccggcccgggccagtgatttccctgtggtttcccgggcgagggccggcctttccaggatgggtccagcccacctcccgcgaggggccccttccctccctcctcctgcccaggccaatcctggctgtatgggtctcgcctctggggtttgctaaggcatcagctcagccccagcccagacctgcccatctgaagccccaggcagttgctaatgatgggagcttagtgcacaagggctgggcctccctcttggagctgaacattgtttcttggggacggctgtgcccacctcagcggggaggcaaggattaaatcaggtgattcttgtgacaggcttgggacaggacggccccgaggtgagtcggtgcacgccagctgtcaccctgacaccctgctgacagacgcatgggcttcagtgccccatctgtaaagtgagggctggaggccccccagcccaccccggggaaatggacccggagccccggctcccagtgagcagcgggggtcccaccaaggggcctcaccatgtccttgaaggcccccaggacggcggcggtgatgatgcccaggaacaggcccaggacgttcagaactgcagaggcccagagcaggcggtacaggtgcagcacgtcctggcagccgctgacgccgatgaactcatagtaggcgggcgagggctctgcgctgcacagagagggcaccatggcgtcaccgcacgaggcaagtgaccacccgcaagttaaacttgtgtcctctggacctgagccctgcagggctgggggaggaaatcagggctggagcccagtcaacgcccatccctgcactgctctgggagatcaaacctatgtctgatgggattggcctgtgaggctccccacctggggcccacagtggcaaagagcggcaactgggcctggcgggcccgcccctccgcctcgatggcctggcaggacgggtgtctgggccccggctgagccatctctgtcttcacgccaggatgggaaggccgtcggggtcacgggcccctgtcccaagagggggccatgcctggggcctcagaggccaggccaggtttaaactctcgcccgacacacacgggctgtgtcctcttgggcagatcaacatttcagagcctctgtcttttcatctgtgaaatggactcaatgtcctttcctcatgtaaacatctaaggagtaaaggagacgatgtaggtgcaggggtgtggggggggtgatgtcaggagcagaaggatggaggcctcacccctgcaggcacatacgggggttcccagcgcccctcacctccctcaggtgtagatataggggtccccagcgcccctcacctcccgcaggtgtagatacgggggtccccagcgcccctcacctcccgcaggtgtagatatgggggtccccggtgcccctcacctcccgcaggcatagaggtcacagcagtaacaggtgttgcttctcaccttcagctggcacttgccgtccagggagtgacaggtgacctggggcagagaggccttgtcaggtcacatgccggtgcccaccacctcacccaccccaccaagggcagggctgcctcatgggagctgggagcggccactgaggcccagccaagcagctgcctcccccgactttcccccgactccagacacagaggcttgggggctcgggggccaggacccttcctgcaggaggggtcaggggcacaggctggtcccagaggccggataatcggggctcagaggagaggccttgcttctccatgatcccaggagcagagggaaatatcagggtgcgtgggcagaaggacagagcccaggaggccttcggcgtggggtgcacagaagcctgagagcccggagggcggcagaacaggccccgtcccagggcgctctccccccaggcttgagcactggcagcctcagaagagacacctgccacctctgtgtgacaaccttgaaagccctggccaggggacaccccccaacacacacacacacacacacacacacacacacacacacacagaggacgcctcccctgacacacacacacaggacacctccacacacacacacacaggatgcctcccccccacatacacacatggcatgcctcccgcctacccccccccacacacacacacaggacacctccacacacacatacacatacacacacaggacacctcccccctaaacacacacgggacgcctcctgcctacccccccccacacacacacacataaacacacacacacacacgatgcctcccggcagctgctggagagtcccagacaagctggcaggtgctggccactgagagggcctccagctcctcctcctctgacacgcgtgctgaggatgagaggctgcgtttagttaaagccaggaatccacacagggcaggtgcgagacacacagagagcgccgtcacagagctgtgccctccgacggtcctggcgaaggcggcggccgcccgcgggtcattactccccgcatctcactcacctggaaagagaaatgaggtcacactgccgctgtcggtggctcagggaaatccagaagtttctcggacactgtaaatgtattatccttgcttcttattgcaataattaaattagaaaaatgctaattggaagagccatacagaactggacacgtgcactctgagactgttgtgatttaatgaagcaagtccagaactctgactccagagtgaaatacagcacatcgaaatgtcaaggtcccaaacacagggggcatcaacggttcaccagctgcaggggtgacccccaggaactattagaatcaaaatattcagaccacgcctatgtgcagggaaaaccgcgtggggtcggcggggttagctgagcaaaacccacatgaatctcagtgctcctgctcacctctgtctggtagacatcgtacaagtaccccaccccactggagtaaaactggcatcttcccgtggtgaggggcctcggttcctagagaaacagataaacacagatggaataaaacaggtgcctccaggcgggagaggccagaggcaatttcaggcctgtgggtctcaggctcagggcctcaaggaccaaggccaacaccaacttgagcctcccagacacagaacacaagatgggagactccacgctccctgcagagcagctgggctgctgcatccaggaggccagacagcagaaagccccatgggagggtacctcgggccatgcatattctccatcagtcaacaagggcagcagaagggagacaggtgcttggccttttgaggggcatccctaccaccccacatcacaggtgttaggctcctgcatcgtttcataaaagaaaatattgtctcttctactaggaaggtagcaagaaggatttcagaccaataaactcatccctccaaccatccaatcatccacccacccacccaaccatccatccaatcatccaatcaatcatctgtgcatccacccattcttccttccatcctctacatctatctattcattcatccataatgcatccatcatccatccttccattcatccacatccatccatccacccatctgtcatccatacttcatccatccatccatccatccatgtatccatccatccttccatccatccacccatcatccatccattatccatccttccattcatccacatccatccatccacccatctgtcatccatccttccatccatccatccatcatccattatccctccttctatgtatccatccatcatccatccttctatccatccacatccatcatccatccttccattcatccacatccatccatccaaccatcatccaaccatccatccatcatccatccattatccatccttcgattcatccacatccacccatccattcatctgtcatccatccttttgtccatccatcatccatcatccatccattatccatccttctattcatccacatccatccattcacccatctgtcatccatacttccatccttccatctgtccaccatccatccatcatccgttatccatcctcctatctatccatccatcatccatccttctatccatccacatccatcacccatccttccattcatccacatccatccatccatccatcatccatccttctatccatccatccatcatccatacttccattcatccacatccacccatccatccattcctgtcatccacccattatccatccttctatccatccatccaaccattcagccatacacccatttgtggccctatccaactatcaatccatccgaccatctgcaacattcatggagcagacacagtgccaaatggtaaggataacgagacacagttcttgcccttaagggatttatagactagtgaagaagacagacccataaactgaccattgcaaagtgcttataattgctatggtagaggacagcaggaagtaccaaaactaaaatgccacaaaactgcatcacctgcaaataagctagggtcacattgcccacgtttagttttattagtatttctcaaaggctcctagttctgaaccaagaaaagtattagaaaccactagtaacactgcaacagatgagaatgagaatcactcatcggtcctttgggcccccactggtgaagtactattatggccggatgcgttctaggtgacacagcaatggaggaagcagacacaagtctctgtctctgggtgtttatcttcccctgaggggacagacatgagaccacaggtaacaatgagtagcccaaggggacagaggctccttcctggagagagggcagtgcaccccaaccccacggacagaggctcctgctgggagggagggcggtgtgccggaaccccatggggacagaggcctagcagcacggtgtcctcggcctctctcaacagttggaaggcacgcatctccccatatgacgcccttagagctgtaattcaccatctgtcttcttcctcagcagcacacgaggcagtgccacattttcctcgatggcatctgagctccagtgagtgctgtctgcgcatccgtcctaaagtcagccctgggaggccccggccaggggccctgctttgtttctaaccaagaggctcccacacttgcctagatgcatgccccgcgtggccctccagaatggacaggcgcccgaggtccggaacctggggacacccccgactgcggtcagagactggaccctgctcctcggcggggccacggccacgggcgcctggagcacagtggaaaccaccgtctggaagccatagaatagcaagtcacccagccacccgctgagaaagctcccatgacgcacctccgtgggagtgtgtgtgtgcgcgcgagtgtgagcatgtgggccgtggtgtgtgcatgcgtgcgcacgcacgtgtgttttgtgaatgtgctcccacacttgccttcatataatgaaaccgttggggcagacaaaggcctaacaccaaccttcagtgcctttcagtgtgatttatggaaaaagagggagaaacaatcacaggtttggtctgagagttcatgacaagcaattcggctgctcccggggaccagctgacgcccagatggcgagagcccacccaggagcccagccagggaggaggggggatggcgcagcccaccggaggctgaggacgcacctcaggaggacacagaaacgattccttggcctgcgactttagagaaaacctgttcatttagaggtgaaaagagcgtggtgtggtgtgtatgtgtgtgtggtgtgtgctctgtgtggtgtgtgtgctgtgtgctctgtgtggtgtgtgtagtgtgtgtggtgtgtgctctctgtggtgtgtgtggtgtgtactctgtgtggtgtgtgctctgtgtggtgtgtgctctgtgtggtgtgtgaggtgtgtgctctgtgtggtgtgaggtgtgtactctgtgtggtgtgaggtgtgtactctgtgtggtatgtgctctgtgtggtgtgtgaggtgtgtactctgtgtggtgtgtgaggcgtgtgctctgtgtggtgtgtgaggtgtgtactctgtggtgtgtgctatgtgctctgttgtgtgtgtgctgtgtgctctgtgtgttgtgtgctgtgtgctctgtgtgttgtgtggtgtgtgctatgtgctctgttgtgtgtgtgctgtgtgctctgtgtgttgtgtgctgtgtgctctgtgtgttgtgtggtgtgtgctgtgtgctctgttgtgtgtgtgctgtgtgctctgtgtgttgtgtgctgtgtgctctgttatggtgtgtgtgctgtgtgctctgtgtgttgtgtgctgtgtgctctgttgtgtgtgtgctgtgtgctctgttgtgtatgtgctgtgtgctctgtgtgttgtgtggtgtgtgctgtgtgctgtgttgtgtgtgtgctgtgtgctctgtgtgttgtgtgctgtgtactcttatggtgtgtgtgctgtgtgctctgtgtgttgtgtggtgtgtgctatgtgctctgttttggtgtgtgtgctgtgtgctctgttgtgtgtgtgctgtgtgctctgttgtgtgtgtgctgtgtgctctgtgtgttgtgtggtgtgtgctatgtgctctgttttggtgtgtgtgctgtgtgctctgtgtgttgtgtgctgtgtgctctgttgtgtgtgtgctgtgtgctctgtgtgttgtgtggtgtgtggtgtgtgctgtgtgctctgttgtggtgtgtgtgctgtgtgctctgtgtgttgtgtggtgtgtgctgtgttgtgtgtgtgctgtgtgctctgtgtgttgtgtgctgtgtgctctgttgtggtgtgtgtgctctgtgctctgttgtggtgtgtgctgtgtgctctgtgtgttgtgtggtgtgtgtagtctgtgtggagagggaagttcgttgtgtaggaaatgagacttactgagaggagagacagtcactggcaacccccagcgtggagactgacggtgaagccgtctgagctgagatctgcaaaatgaaattgtacttttttcacgtcgactctttcagccccggaaagcgactgtgcacacaatgacaatgtactcacaatgtgctgtgctgcaaatacgccgtccacgatggcgcagcagaaggcggccaccacgccaaaactgataaacacgatcgctgccaccagctgcaacagaaggagaggtgtgggtgcccagcttttaccaaccccggttttcaaacgcaaaccaattcaaagtcccagctcgaggtcggggcttctttcacagaactgcctcttctcacctctacctttcgtcctatgacttccagccctggccaggccggactccaccctgcgggtcgtcctcacgcgtctattccgcaagacccacccaggcgccttctgcacggaagggcgttgccatccccgggccctcggcacgcgcctctgagaagcaaccccagacggcagggcgtgtgcccaaccctaatgtgtgctcatcacacgcacacacatgtgcatgcttgacacaggcctttacagtcatcggatcagcttcacacactgtcgcacaacctgcttttcctacctaatggtcttggagcttggagccaggaatggtttatagtgcgttagttaaccagtgcactctgatggatagttaaacagttggcaatttcttgccactacaaactctgctataaagcggggtgtcctgccctaaccctaaaaactagcagggagtctccatccccgtggacccctgaccagagggcgggtgctgtcattcttttctcggtgcctggcttggtaccacgctgggcagagcagaccctcctgaatggccgctgaaaactgtggccccgagttggcatctcgcttggttccgtcccgatggatgagttgtcggctcgggaaagaggtcccagtgacaagcagaacccatcggtaacagcagagggagggcctgtggctcgggcacatggtgctacacagggacaggggaagcctgagtctgttcggacctgtcctgcgcaccaggcacgagcgtgggtgctcgtccagactcagagcagagccgaccgagcagagtggtctcctcctcacacttgcaaagacgcccggcagaggcaccccgaccttccttctccctggggagccaagtatgtggagagaggagttccatcgaccgtgaccctcacgtggaactgctgtggcctcttcccccgatgtcagcatggccctgtgtgtccatctctgccccaggctgcacacctatcgtcacccgcaacccaaagagaagccaaatccagcccatctgccaaggctctaacgctacccgctggattcgcaggtgggacgcattcccatcaggccccacagcagcagaaggcggggggtgggggctggcgggcccaaacctttcaggccatggaccagtggtggccgcctgcccctccctctccttctgaccctccacaccacaggcccgctgggggtcctccctggaagccccatcagagccggtccagggcgcaccacgctgctggccaagcccttttgcggaggaaagtgcagcttcttttttaaacagtgggcaccctcactgcgagtctgggtgtttttatccttcagcagaggaagagctgtcaactgggggcttcctggtgagcccacgcttggcagtcaccgatgccaccttgcattaaatgtgagtgatgaggcggtagggctggggcagcgggccggagagcgagtccacagaagtcagtgcgtccttgggtgggtcccagaccggcacggtccctgcgtgagtcacagagagatggttctcccacctgctggcacctttcttctcaggtgggtcccagaccggcacggtccctgcgtgagttacagagagatggttctcccacctgctggcaccttcttctaaggcaactttcctccacagcagatcagacgagacattctgagagctcagacatcaagcacgtgcccttccaaaatacatactttaggtttacgagaagaggtaggtctgaacaaagtccgggcagttagcaggaagctggccgacacccctgagctctgtctcccagtggctgtgcgagggggcagagggggacgtggccaccagacccaagggcagcacaagggttctcggggtggccttggaccggagcccttaccctcgcatcccccctccacctccccaggcagagcagagcagagctggcaagctgagtccttccagagcgttctctgaactgctgggctggacttgcccctagtggtccttggttccccctctggaaagggaggtgctgggttcactgacttattcatgagtgtcacggacgctccagcgtccccacgggatacgcagcctggtgctgcaggcgcagacatgagcaaaacaggcacctccccgcccttcccgcgtctcacgtttctggcattttatcatcgattgcctaaaagaaagttgagatgctcccagaagaaagctgtgcagaaaaccatggctgcattagcctgggtctgaaccaaaagcttacttctatttggactttctacaggctgtggcaatttaaaaatctcctcttctgcctaattgctctggttcgactgactaaataatgacggagcccatcgcatggtgtagctgcccagtgtgctggaggaacagacagatgagggaggttccctcttgaacagctgaccccgtctgacggccaccatagcaaagcataagccagggctctgggtgcacacacaaggaaggcctcattgcaccctgagaaagaaggaaggcctgaacgagtcctggaagaataaacagaatttcctcaaggggagacagggaaggtgctgggggctgcacgtcggtgggactggggcccactgaggtggggcagaggccacgatgtgcagggctaggggtgagctgcagccaccatgttacggtcagaaggtcgtcaatgccaaggttgtgtggccgaaggcaagagacttccttcaccttcctattttcctgatgaaactgctgcataaaagtaaaatgactattatgcagagctgtgtaaaaacagcgggcagaaattacacctaactgaaatttcctacattcagttaggtataaatacgtaaaatacattaaaaatgtaattgtttgaacaaatacataaaaacacacacagacggctcagagggcaacatttgaggtttcccagtcggggccaagcccctccaccttcccagaggaagatgaaagccggcctccagcggggccgcgtccccagctctggggcctcccgcagttccgggggatgttcctgtcccgcagtgcacccttctcgtgggtgccggcctggatcagggggctgcgtgcctcgctctagcattgcagggagagcggcgtcacatcccatcatgcctgcagacatgcttccagcattagatgcaagcacgcagaggggccgtggtcccgtcaccactgcacacgctccttaagaactcccacagtttctgttgggcacaattcccaaccaaagaggcagaaggaaaaaagacttaaagatgaagaaaatcactttaaagcttccaaagttctttcgctcgacccatccttctaatccgcacaactgtgacatcatcatcacaatttgcattttgcaggtgcggctctaaggacttggggctctaaacatctttcgctcagacagcgcctcagctcaggagcacaagcaccccttccctgctcctggttgagtcaccaccctcagagccactggtgtccccaaggggacatctgtccacacgacgtcgctcccacagatccctgaggggtgtgtgaccagtgtggtcccccagattcgttggggctgcccaacgttaggaagcccacatctgcctagtgggagccgaagccatcccaggaggatccagcgtccctgtccggctcggcggccggcaggtgccacccgctagatgccccggccactttcagaagtgggtggcaggtgactcatccaggctctgctgggtctctcaccgtaaatgcgtgcagcagagactctgccaggatgtgctggccctagatgttcaccttccaacccagtaacccctcatgaatgccatggagccaggaacctgctgcaacccagccctgggcaggacacaggcccagaccgttgagaggtgttcatatttcacccccacccaatttcacccaaaacatcacagaagcaccgaattgttagagcatccctaaaaattgcagggtctaccttccatcacccatgtttcataaacacattcaaacttggtcatgcataacacttcccaccctgcgaacgtcctcgcagatgtcccagctctgcctggctgtccttcctcccgctctttcagtgtgaaaggtaaaattcagcgagagtgtggccacgcgcagcaagttcagtgctaggatgtctacgtgtccggtcagtccagagctaggatatccatgtgtccagtcagttcaatgctaggatgtctacgtgtccggtcagtccagagctaggatgtccatgtgtctagtcagttcagtgctaggatgtccacgtgtccggtcagtccacagctaggatgtccatgtgtccagtcagttcagtgctaggatgtccacgtgtccggtcagtccacagctaggatatccatgtgtccagtcagttcagtgctaggatgtctacgtgtccggtcagtccagagctaggatgtccatgtgtccagtcagttcagtgctaggatgtccacgtgtccggtcagtccacagctaggatgtccatgtgtccagtcagttcagtgctaggatgtctacgtgtccggtcagtccacagctaggatgtccatgtgtccagtcagttcagtgctaggatgtccacgtgtccggtcagtccacagctaggatgtccatgtgtccagtcagttcagtgctaggatgtctatgtgtccggtcagtccacagctaggatgtccatgtgtccagtcagttcagtgctaggatgtccacgtgtctggtcagttcagtgttaggatgcccacgtgcccggtcagtccagcgctaggatgtccacatgcccggtcagttcagtgttaggatgtccacgtgtctggtcagttcagtgttaggatgtccatgtgcccggtcagtccagcactaggatgtccatgtgcccggtcagtccagcactaggatgtccatgtgcccagtgaatccagcactaggatgtccacgtgcccagtcagtccagcgctaggatgttcaggtgcccagtcagtccagtgctaggatgtccacgtgcccagtcagtccagcgctaggatgtccacatgcccggtcagttcagtgttaggatgtccacgtgcctgttcagttcagcactaggacatccacgtacatggtcagtccagtgctaggatgttcacgtgcccagtcagtccagggctaggatgtccatgtacacggtcagttcagcattaggatgtctatgtacacggtcagtccagggctaggatgtccacatgcccggtcagtccagggctaggatgtccatgtacatggtcagttcagtgttaggatgtccatgtgcctggtcagtcagcactaggacagccagaaacatgaaaatgccaagagcttctcatggtgcttcaacccgagtccaggcagtggtgttgggaaagacattgggaatggcctcctccagctcctctggctaagtccgaaagtcattgccagaaccagcctcacgagagctgcctcagggaacagcccacatccccctggactgcctggctctgtcacgacttttctccaggcattgttaactcttgttcagataaattttttgtgacctagaacgtgcatagcaggaaccagatcaattctccaaagacacaagcaacccactctccatagcccatgaggactgcgcatgtctacggccactgccaggagaaactctgtccctgcactggagccacaaggatctggactgaaggctgtgaagatctcattgcattctgttggggcatcttctcttgagcaaaggtcaccttcaaatgcctctgctctcagagtttacattccaacagaagaaagtagatttacaaaaaaaaaaaaaccacactgagcataaggtcatggtgatcagaggaaaagaaggaaggggataaggtggggagggagagtggcccgggtgcagctacctcaagagggcggctgggtctctgtggtctgggacattcgagcagagactcaacaaggtggagaccctgcccaggccacccagcagcacctgcaaaggccccacagcatggcatgtgggtctaaggagcaccagggcagtcggtcggtggcctccacgaggcaggatgagtggggcaggagggagggagggaggcgcggcgcggcccccgggtgcagtggtcagtgggaggggagccagcttccctggggtttcccagaactctggctggggtgagggcagcggcagggcccaggcaggaggtgacggcgatggtgagggccagaagcgcgagtggagtacacaggtcgagtgtgcagagacaaacgggtggagggcggccacacggtgacaccgtgctgatgacggcacagagccagggcccggatgggcaagagcagccacttccatctcacaggtctgttatcacccacacgatgacggctaagatggctgtgtacgccataaatccagcactaggatggccacgtgtggcaggaggagacacagggagccaccagccgagggcagagaggagcctctgctgcgccagtgccaggccacgcaggcagtgcaacccctgagcccccacccaggccagcagctccacctgcgagaggcacctgatgcagcctctgctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccactccctccgccttcccctctgcggcatggtgcccctggccgacacctggagctgcccatcccgtcttaaccacagatgtcttctcaacacctcctccccgtccatgccctctcctccgcctcgcttcctttagagtaaacctcctggagagagtggacggcacctgcagctggttcctccttcctgggtcaccaagcccaaatctgcccctcccaaggtcaccatgccctgcctgccatcaatccaggggtcaccctcagccccagctgacgcgattcaccatgagcatttgacacattcacggctctcacactcccctccccactgctttcccaggcacaacctaattcacttcacaagcaggtccctgctcacagttctaagccatgtacaatttcagctcattaacaatttcctctccagcttcccttcttcacgtctgacctgcacacctgccatgcgggtgtcccagaaccacaaaactcaggggctccccacatggtcgccactgtctacaccctacactcgcaccatccacaccctccaaagaccctgaactttgacctgctcatttcacctatcatcggtttctgtgagcaaacggagaagagaagccgcaccactcaggtcagcaacaggcagcctctgtccttttaagccttccccacacactgaagaaattcttagaacgtttaaaaactgttttccaacttaaaccaatcaggcattattttagtctagaatacatgtttttcaaatgctaataaataagtgataaaggagagcaaccaaattaaaatccagaccgttggctctgggagatgcccaatgtagctcttccgaaaacacccctgcgcgtgcacgtggctgactgtggagctagcaggtttgcacaaggcctactgtaagttttctctattagagacaaaattttaaaattatttaattatgacatattttcacatgttctgttcattaaagtgtcagagtccaggtatgaaacaacgaacaactagaacctctcagaagtgccttacggggcccattgccaggagtaatgtggtctcctgtgtgaaggcatgccccatgcatgtcacatgtgtaactagtgagcctggaacagggctcactcctcctcaaaaaccaagacgtggcctccttctcagtgaatgagaggccactacagatgatctccaacgccaccagcccagaccgagaaatgagaaatccatcgtaatggtttcttctgatgactcgtctgcaatcccttttcctgcctgctctctgacgtggatgccagggaggaaattcactccccagcagagaggaagcagctgctgctagtgacgacagtgatgacggtgatggtgatgacagtgatgatggtgatgagggtaacgacagtgatgatggtgatgatggtgacaacagtgacgacggtgatggtgacaacagtgatgatggtgatgatgatggtgatgacggtgatgatgttgacgatggtgacaatggtgatgacagtggtgacaatggtgatgatggtgatggtgatgatggtgacaacagtgatggtgatgacactgatgatggtgatggtgatgacaacagtgatgatggtgacgagggtgatgacagtgatgacagtggggatggtgacgatggtgacggtgatgacagtgaagacggtaattacagtgacgacagtgatggtgatggggatggtgatgacagtggggaaggtgacaatggcaatgacagcgaggatggtgacaatggtgatgacagtgatgacaggatggtgatgatggcaatgacagtgatgacagtagggatggtgacgatggtgacaatggtgacagcggggatagtaaagactgtgatgacagtggggatggtgatgatggtggcccatggttctctggctagaatcccgaagtccagagccctcacggtttgatgcttgaattcattttacagcaaagcatgccctggtctgaagaagtccatgcacagcctgcatttaccccacgttgtgtgaatgttcgtgtgctttgctttggaaacacgaagtgggagactgcctcagactccactggaggaatcaaacggtctggcccatccccacgttccctcctaaaatccaaaacactccgagaagcatctggctccgggagtgtccgagaagacacagggatgtgtgagtacgtcaagccactatcccaggtgtttttcctgcctctcctgagcccctgagggcaaccctatcatcccttcatcgagaagaggacagggaggcctggggacgtccagcacccacagtcacgtccagagtggggtctccaagcccagcggcaaccgttcctacttctgaccctgaccaatgacctaagggtttcaaaaccagggaaagctcatgttggggagactgaatttctaaatttctgctgacttagaagtttctttaattgaacttttcagctttccagcctctctcctccggtgggtctatttctctgtcagtggtctaagacctctctttgctcatgcatttgctaaagacaacagcaagagaggtaggacgaggagcaaacatgagaccctagtgccagctgagtcagaaaccgcagctgggggtgagggaagcccgcaagcctccctctctgccctgcagtgttttgcctggagggcaacctctgtcatggtattagaagtgcaggtggaaatcagaaggcaaagccagtgcctgcgtgcagggcagtgaacttcaggaaatgactctcagcctgggcactttgccagtgacagagcaggggcatcaccatcttggacaaacactgccattttaagttccctttgactaaaaactgcctaaatccagccccagaaacatcaacttactgactaatgtcagcatgaccataaaccacaaatgacacctccgaccagaaacattccaaccctgcaataaaactctcctccacccagaaacattctgctcctgcaataagctccccgcttcataaacccttaaatacccttatataagagagaacactcctgacctaaattcaccagaagcccctctcaggtttattctccaaaataaacctctctttgatggttgagccacttttcatgtttctttcctctttaactcttacatttggtgccgaaacctaggacaggtgttggggccagaggctctcttgcaacccaggaagccgtgggcagtggcagctcgtcccaggctaattcctagatcctgagggcctctagccacctgccttgtcttttctctcactttactttctgagcaatttgcataaggaggacaactgacccgaagggaactgtgaggcttgggccggggctactccccagtgggctctcaaaatcctcaggtctcagaaatccacctccaaccgctcacaatgggcatttcactctctaacccttctctccttctcctccttctcctcctcccttctcctccttcttcttcttcttcttcctcttcatatccttctctctctctctctctgtcttcctcacgtggctccagtctgggaggcgctttgccaattccaactggaacatccaacaccagacacaaatccagctgactggtaagatctgccctcccctggctttctcatggtacccaggaaagtcagatctgccgtcctggtcctcagaggaccagtgggattaagctggggaaaatcttgggaactcccagtctcttctcaggttaattgtcctctttataaacaggaatctgggtctctgtctttcttctggagacacctagaacaaaaacagacaccctcggcctcctcttaccagctcacatgggtgcccaacaatcccacatccctacaccctccccgctcggctgtctccttcacaacctcaccaaacttggcttacaggggagcctaaagccaaagcgtttagttttttatggtaacacggcctggcccaattcaaactagataacgacagccaatggcccaaaaacagcatctttgactttcaaattctcagggaccttgacaactttataaccaggagcagcaaatgacaagaggttccctatattcaggcctgcctatgtcatgcttgcacccctcatgaaatccttcttcttaaagaaaaccctccccaggtcttcccttcctccgaaatcccttcctccgaaaccccttctgaccctgcagatgaaccccctctgtactctcaaccctctgcatctgctcctcacccgaccaaaccctccaccctgttggcccctcctacccccaagcctttagccccaaacctcacccatcctccttctccaccagtcacccattcagaaactaccccagccagtcaagccacctctgccattctccctctccaggaagtagctggggttgaaggcactgcttgcgttcatggccctttctccacgtctgattttctccacgtctgacttgtcacagatccaacagcacctggaatctttctctgaaaatccctctcattatcacagggaattcctgcacatagcccaatcctttactttaacttggcatgacattgacataattctaactccaccctcactcctgatgaaaaggagcatatggcattcagctgaggccgacgcagataaactccataatcaaaccctgatataaaacccagtggctaacgatgcaggccccgtagagatccagattggacttaccaacagggagacactggcttcaggcaaagaaaccacgtgatcacctgtcccctcgcaggcatggacaaaaatgcccataaggcagttaattatgaaaaactcagagaaattacataagagccccaggaaaatcctgcccttttcttaccacacctcactgaagcgatgctaaaatataccaatttggacccagaatctagagaaggtcaaacttttctccccctccaatttgtttcccaatccaccaagatatccagaaaaaattataaaaattagaggagggtccccagacatctcagtgggacctcctaaatgcagccttccatgtctttaacaacacaaacgaggaacaaagaattcaaaaagacaaacatctccatataaataccagatgctcacctctgctgtccaaaagtcagctccacaaaaagcctcctgataacccgaaagaaaagtcccccacctctgggagtctgtttctgatgtggcaacgctggacactgggcaaaagcttgtcctaaacccctgcccccaccaaactgtgcccaacctgtggtctctggggacactggaaaatggacggctcccaacagggacaccttccccgttcaggtggggctcataatgaagcccccccctccgaccatcacaggaggaaatctcatcgctgccggcactgacaacggaggactgagggtgcccggatcctgcgcccccatgtccagtgagtccacggaacccagggtaactgggacggtatccggtaggccagaagcaagatggagtcagttcagaccgttttcactgtctcagtcataattgtgcaatggcagtttcataactttaaatgattaccacagttttcataaatgatctaggcaagtgattaaaataattagataaatgtaatgggacaaatatttgtaaacaaacttgtcatcatttggaatctaaagttatattaaattaaactacagctatttcattatttaggtttttccaataaaaatatattgtaggaaagcattctttctaaaacttgtatcctttttaaaggttaaataatttgtgtctaattcaaagcttatttaaaggttttatataaaacaaggtaaaagaaaccaggaaataagagagatataaagaaagttacaaaactaaaaagttgtaaagactgttgctaaaataaaaatatcttcaaaaatgtaaacagttggtctaaattatgcaggtcaaatattaggtttattaaatgcttttagatcataaactggttctttgacttaaaaattgttcaatttattttggagtgttaaattctagataaggcctggggatataagaaattagccatgccccctagctatgcaaaaaggtattaaagaaaagaatatttatataagaaaggatcttgtatgataaatttttgtcctgaagtaaaataactggttgtttgaagacagggatgtttaggacaagtcagaaagtcaaggcatgtggtagcttgtctgcgtagtcataaaagaatttatacaagggaatttatgcaagaaatgatgtagaatttaaaggtgattaggcctcctaaatgctttataaaatgccactatgactcttagctgtacaacttgcctgctttatatctaggtaaggcctgggacacacggagtttgatgctggaatgaatcagaccttgtgtgcacttctgtctaagtcccaggcttcacacctagtacatcatttaaaatcccaaacgtaccaaggtcttcaccaaaagtgaaggttgctaagagttaacagtgttacatgtatttaagactattgaagaaacagtttacatgcaaggtgtgtaaggaaagcaaaatatacttttggtaaaaagattataaggaggcacgggaatgtgaatttttgcctagattaaaaggttaaagggttgttttaagttggataaaataaaaatgaaggtttaagcaagttgtgaatggttgattgtaaaggaaattctatttgtaaacatattggctaaagttaaaggggtatcctccagtttttctgcaaattaagcattaaaataaaagcacaatgggtttctcttagagcactagcctgctctttaacaaaaattgtaaagagttataaaaggtctataaaaatcttaccttatgatcaaacattaaaattgggtaaatatgtctataaagttttattaagaattgggtttaacattaatagtacactaatgtaaaggtgaaattcggcttatttggtataaaaattatacaggaagcattgccaaatatgcaatggtgtttggctttctttgggctgtgtttgtataaatatgttattggtatgtgttccaaagttatgggagacttctataattctgatatattttagtgtacattatcagtaataattatcattgttatgttaaaattattgtgtgccacaaggtaacagatttccttgtcaattgtgtctttaactatggctaccctaaaacattttgtcatccataggcaattgttgtcttgttttggtcctgtttagaaggtggtttcataatcagctataaagttttaccaggtgctcttcaatacaggtttctgataactttgaagactgtgacatcagaatagaggaaaaatgttcaggactcttgaagagctaaaatgttcattaatatcaggcaggacaggaattaactacatgaactgaaccaataggagactggagtgatcattttgacattttgcttaaaatgttgctaatcctttgttttgcttttcagagtcaaggaaacgtcttgcgagctattgacagcttttaacaatttagtatactcccatgagcaaaatttggagcttatttgttcctctctacctgattttctccagaatttggaaagtatttgtgactattcttaagttatggcaatatagtgatttgcataagtgcaataagaatctgttttcttttgtaacaggacacaattggagaaactggttattttaccaagactttggttggaatgatgtgctttcctttaaggaatcaaacttgacttatgaagccaagaaaggccttggaaactggcctcctattctgtgtacacagtccctgcacaggggttctgatctggggtaagtaaagaatgtcactttctgacaggccaggaacctcaacaggagaggaattcacccaactcataggtatttaatggtacaattccatggctgggctcagctttaaaaagtcttatctcagattccttctataaaacaaagttccatcaaagacaatttaaaaggcctatgtgaaaaataattattcttgctgcactgtatacaaataattaagccaagtataataaagtaaaccagtcctaccatgtgtcttttaataaaaatggaaaactggagagagaaaattgtttcaaaaactatagcacacctgttgttaaaattccagtcttgtctgatgtttttcaattgttattattttctacagtttagattaaattctaatttttctggctacgagtctccaaaataatgttttcaatttttcctttttccccacttttctaactggaaatcactgaaacctaagctgtgctttcttaaagccccataagctgaagacgagatgtatcagcagacgctccctctacgcccccaaacagagagcgcttccaggaacaaacccacctcttccactcctagatgtatcagcagatgctccctctatggccccaaaacagagagcacttccgggaacaaatccacctcttccacccctagatgtatcagcagacgctccctctacgcccccaaaacagagagtgcttccgggaacaaatccacctcttccactcctagatgtatcagcagatgctgcctctaagcccccaaaagtccagtgctgcattcagtgccccgtaaggaccactctctctcagcaggaagtagccagaaagaacacatcacccctcgtccttttcaactacagggtctggattgacagagcaagaacatcgccatcttggacaaacaccaccattttaagttccccttgattaaaaacccccaaaatccagccgcaaaacatcaacctaatgtctaatatcagcgtgaccataaaccacaaatgacacctttgaccagaaacatgccgaccccaagataaactcccctctgacctgaaaccttccaaccctgccataaaactccctccacccaaaaacactctgaacctgcgacaagctccccttcctaaatccttaaatacctttagtctgtaagagagaacactccagacctaaatcggcccgaagcccctctagggtttattctccaacataaacctgtttttgactattgagctgcttttcatgtttcttctttcttcaactcttacagccagtggccaggagtgagcatttctgggtgtttctctacgggtcagtttctctatgggtcagtggaggccctgcccaggctagaaaaagatcaacaaaaacctaatgtcaggttagtgaggcagttgagtgaaatccggactcacccagaagatgccacagtaccacaggtgatcatcgtcatatcattacagcaggtgaaatcgagactcacccaggagaagacgccacagtaccacaggtgatcatcgtcatatcattacagcaggtgaaatcgagactcacccgggagaagacgccacagtaccacaggtgatcatcgtcatatcattacagcaggtgaaatcgagactcacccgggagaagacgccacagtaccacaggtgatcatcgtcatatcattacagcagatgaaatcgggactcacccgggagaagatgccacagtaccacaggtgatcatcgtcatatcattacagcaggtgaaatcgggactcacccgggagaagacgccatggcaccacaggtgatcatcatcacatcgttacagcagctgataccattgcttgtcgcagacccagctacaccacaggttcagactctcatcttgctgggagatgacatattgaagctaaagatcccctttccctccctcacatctccacccctgtccaaaatcacgtgattcctgttcggccggctttttatactgcagggttctgccagacaggaacacgcctgtcctgcaccgatcctgctggagggcagcttgttccgagccttcctctacaggaatgcatcccatccacgtctcctgacaagctcaggactagtcttgtgctgtccaccccctcaggccctccaccctggcacaggcagctgtgggctcctctctgtgaccctggccagccctgaccggtccacagtcgtccaggaaacccccagagaccacgcagcactgcccagcaccacctggattggttattgttagcaatggcttcaggtggtgaatgacagggtcagccaaggaggaggcactcagggggaggcagagctgcagcacccacccaggaaggctctgtctgaggccgcccaggctgcacagggcaaaggcagtggcaggaagcgccgccctcgctccccccatgacctagggagacggctcatccccctccttaggacaagggacctggtgcggggaccctggggattcccttcccaagaccatcctcctttgagcaaagcctggtggacccgggcgggagctgttctaggtgctgaagcacgtgcatcccacacaccgcagtccctgccttctgggctgagtctagagtcagcacagcgctgggggagctgcccccagagacacagccggggccaccgcgcctcccctcggccccacagcagtctggggtgcacagtcagcgggtagagctggcagcctccgccactgtccagccctgtactgggaacgggcaggcactccaccaggcttgacaggcactgttggccccgcccaggtcacatagctggcaagaggctgggtctgggttcaaatccaggtgtgctgggtgtaaagagaggcagagagatagagagggagacagagacagagagatagaggagagggagacagagctagagggagacagagatccccaaagtgcaccacatcttctaacagatgccgaggctccggtgacatgtaactccctgcggagtggccacagaaacagatctggctgtggctttccatgagaaattccagggccctgtccaaaaatatgcagatatttggacacagccagaaaatgagttggattttccaaacaagcagatgtggatgcagcttctgtggcagcaaaaatagaaattccaggtgttggtttcagacagggcactttacaagcagacagcccaagcacctgtgaccctaggcgaagctctacctcgtaaccaatgcatccataggcgttggctcctgggacctgtgggtgggcgtcagggatgctcagcatggggtgtagctctgctgcagaacgaggaggagcttttcctgctcaccagggcgtcagcaccaccagctcacgcatcaggatgggagacaaccaagggaaaaccaaggtaggaacaggtcgcctgcgcccactgtgtcgggaagctccaggtcagcgacccctctgagtgtcacactcggccccacgtgtccgggaggctgcaccccagcccctgctaaccaggcgtgcccagggaggcaaggctgctcagacagcagaaaaaaacaggcgtcctgaggcgagggcctgctaggcccccactgtggccgtgggacggagccagcagctctgaggtggggtcacgtgcacagctcacagctcggacagcagcaggtggggatccggctccagcctgtctgggctggacgtagctgtcgggaggacgacaggaagcaggtgccgcccgcagaagagaggtgcgtttaagaaaccagagccgccgagtcagcccctgagtggcaggtgcacgatcccacaggcctccaagctcaggggcctaaaacctgggacttggttgattttcctgtaactagacctagtttccgtggcagatgcccaggcagccagaaaagaaggcagggcgggcggcccccaagtcgctccactcacccacccttgtgccagtgcccacccttctcccaaaattaacccaagtctggagggttcaggtggcagcatctttgagcagagagtgggggacgggacagggtcctctttgaacttcaccccatcccctgcaggtgtggcctgaggcgtttgcatggaggaggtgtggactggtgtcctgggcaggtcccaccacggtccaggaggggcggcccggaagactcagcttcagctcacaggccgcacatggctgcacacagagacctgccgatgccacaggccacgtgcacctggaaaagtctgactcaagccacctgtggggccgcaggggtcccatggtccctgggcggggatgtggggccaccggcctgagaaacaccccccagtgcctgacaggcacggagagctggggcctcatcagggccacaggagcttcagggaaagaggcctcggtggtgaggctgtgggcccggcaggaccaaccccgagctgggtgcccagcgagtgtggccgcctgtgcccatgctccgcctgtgctccactccctcagttattcccccgctgtgggtgaggtcgtgggatccagggttggatggcaagtggatggggcccactcaacgcctgtcctccagaacacccggcccttgtgggacctactcggggccgtggggccttggcacgggctcttgccctgggcagctcacagtgtcctcaccggtgacccgcagagccgcccaacactgccatccagggatcccagaaaccactctccaccagccccacccaaaggggcggagaccctcacagcttccacaggagaaggtgcggggcccgacgccccaggaaggctgatggggctcccacgacagcgaggccctgagcagaagctaagcagggcgcaaggaaggcggccgagacctcaccctccagcacttagaggaatggagaaaacgggctcagtccagaccaaagacttctgtgtgtggtgtgtatagtatgtgtggtgtgtgtggtgttgtagtatgtgtggtgtgtggtttgtgtagtgtatgtggtgtgcattgtgtagtgtgtgtgtcatatatgtggtgtgtgtagtgtattgtgtggagtgtgtgttgtgtgctgtgtgtggtgtatgtggtgtgtgtggagtgtgtggtgtgtggtgtgttgtgtgtgcaatgtgtgtcatgtgtggtgtgtgttgtgtattgtgtggagtgtgtggtgtgtggtgtgtgtgatgtgcattgtgtggtgtgtgtcgtgtgttgtgtgcagtgtgtgtggtgtgagtagtgtattgtgtggagtgtgtgttgtatattgtgtcttgtgtgtggtgtgcgttgtgtggtgtatgtggtgtgcattgtgtgttgtgtgtgtcgtgtgtgttgtaggtggtgtgtgtagtgtattgtgtggagcgtgtattgtgtattgtgtgttgtgtgtggtgtgtggtgtgtgtagtgtgtgtggtgtcgtgtgtgtagtgtatgtggtgtgtattgtgtggtgtgtgtgtcatgtgtggtgtgtgtgtcatatgtgtggtgtgtgttgtgtatagtgtgtgtggtgtgtggtatatgtggtgtgtattgtgtggtgtgtgtcatttgtgtgttgtgtggtgtgtgtgtcatgtgtgttgtgtgtgtgtggtgtgtggcatgcatgtgttttgtactgtgtggagtgtgtcgtgtgtgtctgtgcatgtgcacatacgtggggcacaggagaattgccagttaacactgttttatgcccttccctttcccatccctgtgggacctatgggactgtgccaggttacagagctcttcctgaaataaatgattcatatgtctgtttgggtgaggaggaaacagtaactcattcagcagtggaaaaatacctaaagctgatgtgatttggggcattcttcagatgtcaccggagactaacatgataatgggtagggataatggcgaagccattcctaatgatcagatttcatcccttaagtgaacagagtgaaatctttataaatgaaatgatgccacgtctggcatttgcttctaaacaacataggaagagaagaagcaggcggggggtgaacaggacaagtgatggagttgggtggggggcaaggagggttcattgcgattttcttcacccttgtatgtgcttaaagttttctatggtaaaaatttaaaataaaaataaattgagaaaaaagtgttcacgtgtatctggaagcactggaaatacactcgttctctctgtagctgacgttgacagcctgccttgctgccttttgaaataacttgaatgttctgacatctatgcacttaaaaccagtgtataacaatgaccaccgctttctcgaaacctgtcatgaacaagacattctcatgtgcattggctcaaatgttcccagccaccatgcaaatgaagaaactgaggctgaaatgcttcagtaagtttcctacgatcacgcagcactcacggacagccaggttccagctaccacaagtattaaattaatgtgagattgtgaaatatgggttcaccatacaacatcagcccagaagaatgcctctcctgaaaaggcagaaatgagcttgcacaggcatcacagacaacccctcagaggttctggtctggggcatccgggtgccttcctcaccccagtgagggaagcccgtggacaggtgaacaccacacggctctggcagtggccgtcactcttgggtctttatcctgtcattccagtacccatgtgtttttaccgaagccatagaaatggtccccatgcatccagattgtaaaggaagaagcaaaagtgtttctatttgacatgctccagtagattaaaaaatcctgaggaatccattttttaaagaactactagaacaaagaaatgagttccacagggttgcagatattagatcaacatacaaagtcaacagtatttctaaacacttgcaatggacaacccagaagttaaattaagaaaacaattccactcaaaatagcctcaaaaagaataaagtacctaagaataaatttaatttggtaagtacttcatttgataaatactgaaaaataagtaaatttgatacaaaacttatactctaagaactacaaaacattgttttaaaaactaaagaaggtctaaataactgggaaaacattccatgttcatggattgggatacttaatattaagatggtaacactccctacactgagctacagattcagcacatccctaccagaatcccagctggcttccttgtagaaattgaccagttgattctaaaattcatatggaattgcaagggattcagaattgccaacgtaatcctgaaaaagaacaaggctggaagactcacaagcccttatttcaaactcactctaaagctacagtaatcaagactgtggtaccggcacaagcaaagacatatagattaaaagaatagaattaaaagtccacaaataaaccatatatgtatggccaattaattttcaacaagggtgccaagaccattcaatgagaaaagaacagtcttttcagcaaatggtgcttggacaactggatgtccgtaaatgcatgaacatgggtccctacctcacaccatgaagaaagttaactcaaggtggatcacagaaccagatggaagagttaaaactataataactcctacctcataccatacgcaaaagttaactcaaagtggatcacagacccagatggaagagttaaaactacaaaactcttctagaaaaatctaggggtaaatcttcatgtccttagatttgtaaaacattcttagatatgacaccaaaagcatgaacaacaaaagaaaaaataaattagagttcatcaaaattaaaaacttttgtgcctcaaaggacaccattaagaaagtgaaacggcaatgtacagaatgtgaggaaatatttgcaaatcacatatctgagaagcgatttgtatctagaatacataaatgactctgatgactcaacaggaaaaggcagcccaatgtaaaaatgagcaaaggaaatgaacagacatttctccaagaacatatgcaaacggccaataggcacatgaagagatgctcgacatcactaatcatcagggaaatgcaatcaaaaccacaatgagataccacttatcacacattagatggctagaatcaaacagtcagtgacaagtgctggtgagggagtggagaaacaggagccctcatgcctgtctgtgggaatgtaacatggggcagccactttggaaaacagtctggcagttcctcaaatgattaaacagcattactgtatgacccagcaattccactcctaggtacatgcccaaaagaaatgtaaatgcattttcacacagaaacctatgtacaaatgttcacagcagcattattcacaacagccaaagtctgtaaacagctgtaatgtccatcaactggtgtatggataagtgtggcccatccatacagtggattattattattattatcattgttattattattatttgagacagagtcttgctcagtcacccaggctggagtgcaatggctcaatctcggctcaccgcaacctctgcctcccaggttcaagtgattctcctgcctcagcctcctgagtagctgggattataggcatgtgccaccatgcccagctaattttgtatttttagtacagacaggatttcaccatgttggtcaggctggtcttgaactcctgaactcgtgatccgcccaccttggcctcccaaagtgctaggattacaggcatgagccaccgtgtccggcccatatagtggattattattcagccatagaaagcaaggaaatttggaggaagcttaaagacaccatgcgcagtgccagacaccagacacagagaccgcacataacacgttactgcctccacacacaagcccagagtaggaatctacagagaacacatatcacacattactccctccgcaggcaggcccagagtaggaatctacagagacaggaagttgattcctggttgcttaggctgggtaggtagggtgctaagagaagggtgtgggtttcttgctgatgtgattcatgttttaacactggctgtgctgatggttcacatatctgggaatacactaaaaaccattgaattgtgtgctttaaatgggtgagttatatggaatgtggactatatctcattaaagccatttttttaaaaggaaagaaaaacagacccacactgtccacccatcctgtgcatcgccaaagcccagcttcacacccagcttctgcctctttggggaaatcttatggaaaagtcttcaggaggccttccctcctcaggcccacccaactccctacaggcaccaagcagctccagactctgaagagatgctgtctagagaccatcatgggggcatgctggctcccaaaggtggcgtctgtttccaacaccattctgtgactggtgtgtgtgaggcctttgcccaccctggtcagctgtgacgcccaccctcgggagccaacaacagggggtgggtgggagaggaaatgccgggcctatctctccgtctctttgcaactgctagccaagaacggcagctcaccctgcagtgcacactgtctctactatgcagaacagaacgctttgctccaccagaatcccagtgtctttgcagccacccccaaccctccagggacctcccaccctcacacggtcaggctccatctgcccaagggtcagtctcctgggcagcagtgggagtttgctgggtcccatgcggggtgatatggtttggctgtgtcctcacccaaatctcatcttggatcctcatgtgttgtgggagggacctggtggaaggcagttgaatcatggggggcagatctttcctgtgctgttctcatgatagtgagtaagtctcacaagatctgatggttattacaagggggagtttccctgcacaggctctgtctttgcctgctgccatccacgtaagacaggacttgctcctccttaccttccgccgtgatcgtgaggcttccccagccacgtggaactgtgagttcaattaaacctctttcttttgtaaactgcccagtcttgggtacgtctttatcagcagtgtgaaaacagactaacatacagggttccgagggcatacaccgcggcccagccatctcaccctccctctcggcctgggaactgggaacaggcaggggttgggggcccgacacaggtcatttgcacgctggatgatacagtaacatgacagccggtgcagggaagagctgagaactccagcctgctctgaagcaacaactgggagatgaggcagaaatggcccaaccacctcccctctaaaccctgctcttaaaattcaatcctggctgccaccgtgaactgacaaaattagccagtttttgtttttaaagttatagtccccaaaacagtgcatcaacaaaacagacttccagctgaacctgatcgctgttgccgcgcatacagccacgaacatcatggacaggcagtgtctggatttcactctgcattgctgccatgtgaaccgggggctccctcctggttttatgtctttacctctcctcttagtctgggcaagataaacattaaccaaactcagacgaaaaacaagactctagagccactggttcaaaaggaagagaggcttatgcacatgtttttgcctgaactttacacactaggacttaatttaatttgccacccccgtcccaaacttcatgcattctctgagcttcccaggcctcagcattggtggttgcacaccacgtgaggttgatacaccagcaacccagggccatgctcgcttagactaaggtgtgaatggtactcgctgaaccctgtatccaggactgtgcaggccacagcccgggaacctcagagctggtcctgtagacaccagtgtgctggggaggcagggctgactcttctcagagccccagtgcagctgtaccatcccctgatgagggactcatgctccccaccaccccatgtactttcttaccatttgccttctattctccaccaagttgatgccaataattcctaagaaagatccaaagccgagctaaaaccaaaggaagaacgagagagaaacactcattaacgtgcctagaagcttaacactgacatttaaagcaaataatcccgccctcaaaggcattttatccagggacgaaggccagacatccctacctcaagaacctcaaccactgagcagcaggtgcgtctgctggcgttgggcaggcatctctgcaacatcacctgtcctgtcttctctgctcagaggtttttaatgatgcatctgtttggcttgtgactctggggtaagagaagttcccactcctcccccagagacaacatcttttcgggaacccagggccaccaagcaccaccatctgtcccgtcttctccaggcctgagatgcccctgagcatggctcctgggtaaggtattagggaactacagccgtgtttcaaaagaagggttgccaggcacaagggccaccagtgacccctgctcagacggcctaactctggttgctgcttcgggagagtgagcagggcagaccgttagcagggaggtgccaggtgtggggaaagggcacctgagccaggcacagagggggcacctgggccaggcacagagggggccccgggctgcagcacaggccaccaggggtccggcagagcccccttactccacaggaagccccagctctgggcagaaaatgatactgggatgtcgggaaatagacatgggactgtgctgtcttagaacagaggccaccggccgggcatccgcaccctccacccagggcccgtcctggcaggtgacgcccacctggcagaggaatttttaaaatcagtgtgaagaacatgcatttcagcaacacccaccgaaaatctggctcagagcagccaacatggacctgccaacgaccgtgccgaggcctaagacggctcttgctcccacgcaggtgcgccgggccggtcgcacttcccagtgagtgtctgttggaaggggtggcccgcccggcacagccttggagttgctggggccgtggtgtcaagtttaatgcactggaaaccggacttctttatgtaaatagttttgccttttctgtaattgtctgtgtgtctgtggtgatagacacgtacacatgtggctttcaccaacggtttgagaattctccagggataacaggaatatttcttcatgtgctgagcttcaaaatactgcagttcaactccacacgtcaaaaatatcaaaatttcacttcgatatacatgtattaaaatacatctgttacactacgttttattttttggggatttgaaaaaaaccacacctttcttgaaaatgtggagatgttttcacgttctggccgcttcttctgagatcagcttcttaagtctctacattggcagaaagtctccacagaagtgactcttagccacgtttccttgaagctgcttttatttgttgtctccctagtttgctttcagaactgtctgtactacaggccatttcaatctggtcagcacagcattaattcattgcccagaaggtagattctttacagagcatagcttgggcattagccattgatgtttttcattatgttattctgaggcagctcttaaataagcttgaggacaaaccaaaaaaaacaaccactcaaggctgatcttgatgtttcgcaaatcacttggaggtccctcctcacagccacttgccctctgggctcccctttctgcccaggaagcagaaaagcccctcacatgaggccaaggtccccacaccattggcctcttgcaattttactgataaagctttttctgcatagatactatttgtatatgtttattcataaactatacacaggtagatagtgtagatgtctaaggcacaccctaagatataaacaaaggaaaatataatggtgaaataaacagtatttgtaaaatatttctaaatacttagggccaaaaatctttcatctttgctgattgtcatcaatattattaccaatcttggtagtactttaggtgagagtaatgagattgaagaagccgcattttaaaatcttgctttagcactttatgacgtagcaaccaggctctggggcatgtgaagggcatcgcagctgatccaagccattccaacagaggttcactgtgcagaatgcaggcacttaggagaattcttttactaacgacagaggatgtaatttcatagttcaaaaaaccttgatacttttgaatctgggtgaccaattcttgccaattaggttaccatcaatttacctcgccgccttactgttcaaaatctggcctgacgggtggatgaggtcagcaccaccaccttctggccgttcccacgcgatcacgtcactaatacgatctttgacccacggcttcttggtaggaatcgtttaaagttactttccccttccatgggctatggtggtcgacctggtccctcagggtaaaatccttccaggatgcttggggaggctctgtccggcctttttggacatcctgggctcctggcccctcctccaccttggacatttcctgttgccgggctctggcccccctcctgccctctggtcaccctgtgaccacatcgggccaacccagacaatggagggcacctggccctattttgagatcaacttggacctcaaccccaattcccctctgccttggacctgccactgtcccaggtcctggggattgggaagtgcatgtctgtgggggccataaccctgccgaccacaagcactgatcgaagcctccccaccttcagccccagccctgtgagctggcgtggactccaccctgagagagccacacaccaccctgccctccccggcccaggccgcccgcccggcgcactcacaatgatccctgggtagtagcccccaacggtcacattctccgtcctggtggtggcagccagcccgacggtgactatgaggacggacaccagcagcagagaccccacaaaccagagcgacgtcttcttcctcctcgaaagcccttctgtggggaggaaggcgaggacctgtcagtgagggctcaggctcaggagggcgtcaggccagcaggctctgggccgtgctccgttacccaggggtcctgggatgcactatccccgcctgcctccaggcccacctcaggggaccacccccaacctccattagataacagaataaaatctctggaccataagccactatactggatagcctggtatttgcggccaaacctaattctaactgtcacagaactcaagaaagcaaactagaaaggactccttcctattggctgcctcttcctctatctgactttctccccctggtgtccccaggaggacaggagcatcttttgtttactgttttatcattaccattcgctcacagacacaccctctctatccgcctatcccagccacacccagtgggggagggggctgccaccaggggaggggcagggagagaggaacgcacacagcagccatccagctgtgccatctgttttgctttattttttgaaaactgaatcatcttgatccctgtgtgactccaaacaaaataggggatttaaaaaaccatggtaaggtcttcctactccaagagtttgaaaatcaacatttgtgtgtgtgcacatgtgtaagtgcgtgtgtgcagggaaagcagaccgcacactggagagccgctggcagcgatgacggccgtgcagacattgtccacaccctagaaggtccgcatctgaagatttacacttctgcaatcccatcagcagagctcaatggcaaggcaaggttatcgcacccaaggaagggattgttacatcctcagaaatgagtttcacaaaactataaatcaatgtgcagatgcagaattgctctgctgatctgagagagtcatttttatccagctgacccagcaagggcgtggccttggtcacggccttccttcaaggccctcttggactcagcacagcccccggcacagcaccctgcctgcctcttgacccttgcaaagatacacttgtcccaagaatctcatcctaaatcgctttttaccttccaccttggaggggaccagatcactccattcgccaatgtaataaaccatcggctcccaccagccagccaggctgcccccgtcttggacccactgcaccgaggcggccagtggcactgtccttagtgttatactccaggccgcaggcagtggtttcagcctctccctggttgccccatctcctgcctccttagaggcaggcttgttgcagcatccacagggcctttgtacctgctgtctccagctagacactcgcagcactccctgaaggcctctcttacatgttgctgcatagacacactgagtatagtagccacactcacccctgtgctctccacagttgccccttcacccctgcccctgcagagcatcctcgcatgtgagaggcagaggggacaccagacagacagaggcacacgctgcaggcattggaaaaggccaagttcagtggagaaaacttaagcagggctggggacagggcgctccggatgtgtcacccacaggcagcgggcagagggcagagccttccctgaggggcctggtgatggcacagtgcacccctcagcccagcaccactggtgtggagtgaggccctccttctgaaagccaccctcctgagacaccagaggccgcagcccggtgcgggccagggagcaatccccacacccagcctcaggaacacgccctggggttcggggtccctgcagccagggccacacctgcgccctccgggtccccaaggcagcttctgcaggggtcacactgaataaacctagaggggtgacaagcaggtgggtgcaggggcgggcacagcaccaggagccccaaggccacactggcggcccaggacctggcacctacacatccatcacccagtgtctgttaaagtcatgctcccccagccccaacccgtgtccccgtgtcccacgcccacgccccggcccatcccaccccaggccacacctgccttcctgtgtgcatggagcacgtcctttcttgtctttggatggggaggacactcccctcaagtgaccgaggcccaggcacccgacacctgccctgcatgaggggatgggcgctgcacctgccagccggaacacacggcccaaggcctcctccagctccgcctctcagtccctcgcttctcagcctcaggcttccttcctcctccccacctctaactcgcacagttcttccctgtgtctctcatggtatttctgaactaaaagccaaccctcgttggactggaaaaggttgggaagatgataacgacattcttacaaggaaaagggagacagtgggtatatgttggaaagtgtgatttttacgctgctcagaagagcagagtgattttttgtagaacactcataaagtactgaaaaatgcaaaagggaaaataaaattcatggtaacctaaattaacaagtaggcataaaatcttatggtcttttttcaatgcactatgtactttttaaaacatttttttcttaaattaggaccacaatgctttatagtaattttttcactgaaatcttgcaatttgttaaaaacctgaaaggttatatgttcacggtcgtttgcccgagagacaggagcgatggcgacagatcccgggtctctgtcgggaagtcgaggtgagaaacggcaaacccacgctgggagcaagtgggcaagaggaaggcaggcacctcccgtgggtgaaactccgttctggttgattcgttttagaaaggtaggtaaactttttaaaaatggacacaaaatttaaaaatatatgcaattccacattttggaagttaatgaaacagctattgtggaattacacaaaataatcatattgatgataataacaccatctatggattgggctgtgtgtcgattttcagagcagcctaacttccttatctcatttgatcatgaccagaggctccaggtcaccctcaccagcctccatgtaacacctgccaatgcagccaaatgctaggtgccttcaactcacacaattcccgcttcagcctttcctgcttttccttaggctcccattccaatcttttgactgtttaaatgtattttaagagcaatacaatttctaaaactaaattttatgggactaagtatttgagaaaattatcagacaaacgctgtccttctcaaaggattttgttgtgcgatttttcttaattaaatgcactgcatgcatataatattatgctcaaaatagttaaccagatgactcagcgtctgcttcgacccacaggtagaaccttccgtggggctcctgtcccagcctcctgtgggcgtccgtctgtcaggaaccctgtgactggattctggttcttaaagctggaagctctgctcggttccttggcatgaagagtgggggcccagcaagacccactgggctaactgaccttgtcaagtcaatcggtaacatgctgacttgttaattactatgcgaagagttagacacatctcctctgaaaccacgtaaatcctcctacaaaccattttcaacctaactttgctatgtttacccctctttcctgagtctaacttcccccccatctgctacaaaataaaaagcagaaggtatgagccacccttttatcagcattcctatcacagattcctagattatacaagtctagaaagacagtagaacttacatggggcactgggagcaatggttgcaaatcatctcattcaattacacaatggtgatattttgactccagatataatagagataacaaaaagaagactcccaaccttaaacacattctataaatacatgacacagcataaaaatgagaaaaaaaataaactcaagaaaagaaggtgggatatctttataattagcataagagataattataaggtcagattttcaagagaaaggggctttcacttaggagaaagataattaaaatcacctgaataatttccttgatttttttttttttttcctgtcccggaaatactgttattacacgcactgtgaaaattaaagtgctcctaagtgccccaactattaattaaaatatctaccaataggtttctattgcagaggcagcttacagggactggacccaaaccattctgggtctgtccagacccattgtgtggtcttgggcggccatttaatctccctgagcctgggagaagagaaccctatgagagccaagagctctgtctcttgtttgtcgccggttcccggggctcagatgaggacatagacacatctcctggtacggaatgaatgaaggcacttcagtctcctgacctgtaggatggaaatcatgagaaccacctgctcacccacctcttgagattgtgataagcgtccagtgagacacgatacgtgggctctcatataggtttttgtaaatggaatgcatatgctaatcatcagggtggtgtgaactttaagatggcgtagcggctattcttaaccagcatttctcccactggagttgcaaggaggagttctgagatgtgaagctgaaggggccaacagctacctctctgctatcaagtgcgctgatttttctaattctagtcttccccaggtgcagcccatctaggatatctcagaatatcaccttgtcactccccaccagcccccacttctcccatcccacctgctctccccttcctggctccttccccagccttagctggaggagctgaaccacaggagcctgtgcccacgccaggtcctacctggaagacacgcgaggctggaggtcaggctcttcctgcccctcagacccatttcctctactccacagagccaggaaggggaatgtcacaaagcatgggaggtggcactgcttggaagggttctaagatccggccttcctgccagccggacctggaacgcccaaaaagaagagtgagttccatttaatcatgtggggacaccagtcatggtgtccaagtaacaatcccaggtaaaactgtaatcactcagccgtcaattcctctttcgtcctgattttacacatgcccagggtagtgaacaaagaagggcaaagcagaaaaacccataatcctacccccaggtaccccaaagcagaaagactatggtccacccccagataccccaaagcagaaaaacccacaatctacctccagacacaccaaagcagaaagaccataacccacccccagacacaccaaagcagaaagaccataatccacccccagacacaccaaagcagaaagaccataatccacccccagataccccaaagcagaaagaccataacccacccccgataccccaaagcagaaagaccataatccacccccagacacaccaaagcagaaagaccataatccacccccagataccccaaagcagaaagaccataacccacccccagataccccaaagcagaaagaccataacccacccccagataccccaaagcagaaagaccataatccacccccagacacaccaaagcagaaagaccataatccacccccagataccccaaagcagaaagaccataatccacccccagataccccaaagcagaaagaccataacccacccccagataccccaaagcagaaagaccataatccaccccgacacaccaaagcagaaagaccataatccaaccccagacacaccaatgctttatacattttagtaaaagaccagctccaaacaaaaagacccataatcctacccagatacaccaatgtttcatatactaaaaagaccagctccaagtattgttttaaggtttaaagttctttgtcagaagaaaatctaagtcagatgctatttttaaacattaaggcattctaataatgataaaactagttaataaataataataatagttatcattattaaacaccaatagactaatccacattaatacatttgaccatagagcattttgctttagattggaaggcatatagtggtttcttttagaaagaagccaaattatttgattattttaagtaacagtaattcgtccggttccgaacgatgccgcagtaaaagggttgtgaggttaatccccagaagtttgtgttggattatttctgagggagcggcagagccccctagacaccactccatccctccctccagccgtcagggcttcactttctagggaactctgtttctcttttgttctgaaatctgcccagccctctccccctcaggaagacacccggcatccttccagtcctggccacttcccggcagagcccccgagcccggcttgcgaactggtgaacacgcaacaggtttcctgttttcccagcctttgcctggctccgaggctgcagcgggcttggtctgggaagtggaagaattggagattccgtgaacacaccggggagaaacacgagagaggggcgagccgaaaccaagcaacactgtccagttctgtgagcgcctctgcacgttcaaacaggaaaaggctacctcgctcttccaaacgaagttttcccggaaaatggtgtaggttggaataaacggaagagatggggaaggagcgcactttggggcgcctgttcctcataataaaacgtaacagggagagagagaccaagaggaacggacacagagtcagaggaaggcaaagactgaggaggcagagacagaaagagcgagagagacagagacagagacagagagagagacagggagagagaatgaatgaacgaaccggtaggacgaacgcccgaccccagtgcgaaatgcaaagtgttccaaagacagagctcgaaggaggcggagggaccagaccccgtgccgcgtctccgcgcaggttccgcccgggccggccggggacctgtagtcccagccccggggtccccacgctcccccgcaggagccgagacgagcccccagccccgcgctcacctgcggggtccagcaggcccaggggcccgggcaccggcggctgcatcccgaggccccacccggctctcccggg

SEQ ID NO: 2235 - DNA, 13194 bp, Homo sapiens
tcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 2236 - DNA, 43526 bp, Homo sapiens
accgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacatacagtcacacagacatgtacacacatgcatgacacgcacacacatactaacagacatgtacacatacatgcacacattcacatagacttacatagtcatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacatacacagtcacacacacagacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcacggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcatgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttcctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagtctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcatggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatccatccagtcacccattcacccactcactcatctatccactcactcacccacccattcactcatccattcacccacccactcacccacccacctattcattcattcatgtattcatctatctactcactctcattcacccattcattcattcatctgtccatccattcacctatccacccactcatccattcatgtactcactcatctacccactcactcattctttcattcattcatccattcactcacccatccacccactcattcattcactcatctggccactcactcatccacccactcactcattcattcatacactcactcatccatctattcactcattgttttattcattcatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagggagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcaaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatattggctgatgtccaggttatttccaatttccatcatttaaacaaaactggcgtgacatcctcatgcacctgttgcctcccacacgtctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcagtgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacggtgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggtggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 2237 - DNA, 27233 bp, Homo sapiens
accgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatga

SEQ ID NO: 2238 - DNA, 15497 bp, Homo sapiens
attgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 2239 - DNA, 190027 bp, Homo sapiens
cttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtaggaggcccctctacggtgggagatcaaaaaggttatgggaggaaggggagaaagctgtgagaagcgcctcccacctaaagtatgccttttcccgttgtggctgggacttccgctccgccatgacacagcagcggcggcggggagggaggcgaaacgcgcatgcgcccgaggacttggacgggcggaagtacgggaatggggagggaagtgggggagcgggagaggaggggtcaggggactgctgaggaccagaagtgggcggctgctgggtgcgggagtaagcggcacgggggaatgttgaagttgggtaggaaaagaagagggtcttttaactagtggtctcgttgcttgccactgaagctacctgggcttgacttgagttttaggaaggacacttagatggtttaaggttaatttttcagaggtcaaacctttttttagacctctttgtagctcttaaaagaatgaaattgttatctaatttttgtttcatcctaagtttaagtagttgccaagtttgtaatgtctggcttgttgaaaatattgatatttataaatgaaaatattaagtcactctgagatttatgcaatggaatataaatagggtagtgatttaacatccaccatcttcatttaaaataaaactcttcaacaatgggaaattttactcatttcttttcctctttgaatttgattttcatttcacttttcccaccgaattaccccattgttttgcttgagggttttttttttttttttgctcaccctatcatacttttctgcaatatgtatatgtacatatatgcacatgtatgaataagtgtaatgctttttcttaatttcctttgacaataaggctctcttagaaacaaatgctggttctttggtgccaaaaagaagaactagcgctcaaagaattttctcagcaaggcaattttacctctatagaagggtgcgactcgcggatgaagcaatggcaacggcacacctgaacaggggaggggaaggggttcttattcctgatgcaggtagcctctactgctgtgtctttcccctactggctagggttggaccgcacagtctaagctaattccgactggctattttaaagagcaggcgtacgagctcaagtggcggggtgaataatttggcaggaagggtggttacagaacaggtgactcaggatgattcaggtcagagcaggtgaccaggggtgactcaggatggagcaggtgaccagaggaatagaggtgaactactgattagaactggtggaaaaggttgtttactgaaactagaggcgaggagaacgaggaagctagactttagagcgcaaagaaccgagcatactgacatactgattctttgaagagaaatttagaactcattgtattcaacagctccaagtattaaattttttgtctggatggagttattattgaaattattattagaacactagatgaaaatataaaaagtatgataaacattattaaaatttaaaggtaaatttgtgttagaagtttatttttttaattttatttttttaagagatggagtcttgctctgtcacccagactggagcaagtgcaatggcacaatcatagctcactgcagcctggaactcctgggctcaagtgatcttctgcctcagccttctaagcagctgggactacaggctcatgccaccatgcatgactaatttttaaaatttttttgtagagaaagggtctctgttgcccaggcaagtctcgaaatcctggcttcaagggatcctcctgcacttcgcctcccaaagtgatgggattacaggcgtgagccactgcactcagccagaaatttattaatgagaagactgggggtgtttatggaacctcggttggtggaagagttgaattatccttgtatttggtactctagaggtttttacactttggtgcagtgtaccagggtaagattaagaatgggtaaaagtgtgccttttgtaaagagatctttttttaatttaattttatttttatttcctataggtctttggagaacaggtggtgtttgattacatgaataagttcattactggtgatttctgagattttggtgcatccatcacccaagcagtttacactgtacccaatgtgtagccttttgtccctcaccccgtcctaccctttcccccctgactccccagaatccattgtatcattcttttatgcctttgcatccttatagcttagctcccacttagaagtgagaacatagaatgtttagttttccattcatgagttacttcacttaggataacaggagacctttctttcaaaggatgattgtgcaaagggaggtaggaaaggagtctcaggtcagttttaggaaggaatatatgtggaagttgaagatctggaaattgattccctgaacattatgcatggatctgtactctttagaaagtctttgagtgaacccagcggtatgttatcctgctttgaaaactgccacaataagtcaccaaaacacgtaatgtaaaatacgaaagtggtggcaaagatcacctgacagaatggtccactagagacaaatggcagtagtgaaggagtctgtgtgtgtgtgtgaatgtgtgacatttattatgggtgttctttgtgctgagcatttcactgttgtttacttaatcatcacaattttgtgagatgcatgtcttattcctgttttaacaaggacaaaacaggtgcacagagattcagtaacttggacaagcccttagttgacaaatgggatttgattctacatctctctgactttaaaagttgtgctttcccattataagatgttatctgctattacattatatatttctattaactatacaattccacttttgtgcacatagtggtaacacggtatataatcaatttggaccagcagtaaaaatatggaaaagagaaacgtactatacataaatagtggggtttaaaaagtcaactttagggcaataattcctatagtttgcagtatgctaaatggaagagagtacatgcccactattgatcaaggcatagtatgtagtacaaactcaccatcacatatttacatacatctacattgacattccctgacaatttagaatgtgccaagctctgtactcaacattttacatatattgtctcatttaatcctcatccctgtaactgcaatggtttttctcatttaacagatggagacattgaggcgtggggaagtaacttctttcccagttatacacaagttaagaagtgggatttgaatcttagtagtcttttttttttttttttttttttttttttttttaacagggtctcattatgtcacccgggcaagatcatagctcactgcagccttgagctcctgggctcatatgatcttcctgcctcagcctcctcttgagtagttgggactacaggcatgagtcaccatgcccagctaactttttaatttttccttggtagagagggagtctcactatgttgactaggctggttttgaactcctggcctcaagcaagcctcccacctcggcctcacaaagttctggccttataagcatgagccactagcctgggcaacagagtgagactgtctctaaagaaacaataaaataaataaagtatggaataataaaattttagtgaaaactgtcttgttagaaataatggctatgaaagtaaattcgcaatggaagaacctataattgggaacatttattatggacaaaatacggattgataaagtcatcattaaaatatttgagtggaaactattcccagtgaaaattgtttcaatgacatgaaagtgaacatggaaaaaatggaaaatgttttaaccctcctgtatggaaaattgatcaatgaattaaattggcttgcttgagtttattgcagaaaacgttttccaaccaaaaatgatgtgttgttagtatagggaccgtacaactggtttaagccaatatggatacattattatgaactaaagtccttacttttttcaaggtttccttagtttttacctaatgtcttttttttggttccaggatcccatccagatacatttagcccccttgcctcctcaggctccttgaggctgtgacattctgttagacttaccttgttgtcgatgacgttggcagttttaaggagtactttgaggtcaagtactttgtagaatgctccccaattgggatttgtctgatatttttgttatgataagactgggataatggggtattggaaggaagaccacagaggtgaagtgctgctcttgtcacacctatcaagggtatatactgtcaatctgacttatcactgttgatgttaaccttgatcacctggctgtgatagtgtttgtctggtttctccactctaaagttactcttttttttctctctctcttttcatcctgtactttaaaaaatcttcacattctcaaggagctccacgttttttccccatcaacttcccttgcatcaaggactttgggagagggttaagagagctggggactgagcccctgtgcttttagagtgtttgtaactgtggcctggtttataatgtttctatagatgtttaattatatttacatctagaataatataatctgaaaatttgaaagggaaattgattatgctgtgtatagatgctttgatgctttaccagctctcaggggaatactaatgacactcctagaaatgcattgtgactatctgttggtatacatgtgcttagaatttttttttgactgagtttttttagaataagagtagcttatttgactactgatgacacagaattctttcagtgccactttgccagccagaaatctccacggctagtggcacctctgcccaggctttgcttgggcccactgggcttactctgcccacttggcccagcagactgcgctcaggctgtgctactggtctggatcctgcgcttgccttggctctgtggtcagcccgcagctggtccaggggtgccgtgaccaacttctaccttggatgctggtgtctggatgagggggatgtggcagtgcccaataacttggagatgccagcaaccacagagccccaaggtgtgttacagcttttgcttggggagtcctgaggcctgagcctccagaaagtgttacactgtcgttcatttctgctgtctgcagcttcagtgaatgggagcgtgtcacaactcattgggtcctgctgcctgcagctcagcaaatgggggcatgttggcacacaatggttttttcactcctatagctcggcgagcatgagcatatgttacagctctttttgcacctgccattcgctcttgtcccatgaccaagaggaatgaggtacgcggacactggagagtgaacaaggcagagaagaattttattgactgacagaaaagctctcgataaagagaggggacccgaagtgggtagccctctgtgtgagagggggcctgaaagtggatagccatctgtaaggctgagtctggggtttttatgggctcagaatggggtgtatgctaattgttccatgggtgggcctggaaaaagcaccattcagttggctaaaaggcatcgaggaagttctcactctggttgtggactccacctggaactggcaactcggtttcaggtttcacttgaaggtctggtttcaccggagacctgtccctgtctaccgaggaatttgtctgtttcctactgctataactgagatgaataccatatttcttaaatattgcttaaaatgaaaactgggatgaattattaaatggctttgtcagataatgcatgatttagaagtacacatttttcttacatagacaagtaaatggaaaagctgtgttttagaggttgaaaatattaagtaccaccattaaagtcaagaaacataaatatggttaactctaattccctctcctgtctttgttcttatagtattttatttatagtagttatactttgtgtttatccttttaatcattctgctttcagctacagttatctgtgtacacttgtatgtgtctctcactagaaaataatgacagtattttgaaggtcaggctggtggcttgttttcatatcccctacacggctacgcctctagtgggtccttcaaaagtgaactgaattaaattgaagtatttggggatatctggcttggagaagaaattgtagtgtgatggctgttttaactgtttgaaagatgccgtggtgtatggctccagggaacagaacctggactgatggtgaaaggttaagtaaggcagaattttattccacataaggaaagctttgtaacaattaaagatatttacagtcattaagggctgctttgtaaggcagcatatagatcacttcctgcattcaaaattgacacatgcagtcagatcccaggatgaaatggtaggttacaatataaaaaataggattttacatgaaaaggtgttgacatttaaaactcatcacaggtttctttaaatatcagtgtgtgtttgtcaattcaaagtatgatttactttgcaaacattcctctcagggtttctcactgacacctctttccacaaagtgaggtacagttgtagtggactggaccttgactgagcagcatatcgtgctggagtcttttatcaccaaaagggctgatgtctgccccagtttccagagcagagtgtctgtaaaaaacctgcatgtgtcatatcagctttccttctcttcagcaagtgaggtggaaaaagtatggggaggccacgaaagcccatagataaatctcctacagaagccctgtcccaagagggctgtgttccagccaacactgataaagtgcagaaaaatgtctccacatctaccttttctttctatatagatatctatctgttgtgcagtatgcttcatactaggaatcaggactctcagaaagattctgggaaaattcctggtggcttatgaaactttgagcagttgattcctgcatggttcagtgccttgcagagttaatgggctagaagtcttgagactccttggctcaccttcctcccaaggctttaaaataagagttgtagtttgaggggcccaacaaataacacctatcttcattgtgtgagttactgtcaagacaaagagtaaagcggagttttaggaatgtgatgtctatctgcaggtaagtggactttataatgacctgtactacagaattaaacagtggccaccccaaacttcaggcacagggaggctactctagggtagagccagaagtatgatccctgtgggtaacttgctcccagcgggaggaagaagaggacatgcctgggctgtgcatgtttctccttctaaatttacccagtagatgagtcactgcatgtccctgtgacaagggcagggtagaaagtagccaggaatgacacactaatgatacgcctcctcacagaaggaatttccgctagagagaaagatgctttctcctgcagaaataagttataaaatctagagagagctcagtcatttagttctacttgccgtacttcaagaggatcttcactgcagttgttttggtatggagtgataggaaaaagtcagggaggttgtacggtaagcaaaattggagaatgactgcccttgttctacaaatagaggtaggaaggactacatcatagtcctgttttctgctttcctttttttgtgtgtgtggcattaacaaaattgagatataatttacataacactaaatatacagtagtttttagtatattcacaatgttttgcagcattaccattaattccagaacatttccatcacccctccttccctttaccagctgcttcccattccccacctcattcccccattccccacttcttcctccatcccctggcatgttaaagtgcctcagggaagtcagggacaaagtctctgatgtccttggcctctccctcaagatttcaagattgctgcttagctccaatcataatattcataccatgattaggagaaaaaagggtaccagtgcaataccccgacatggagaaaccactaactcccagccaagtcagcccctgttgaagagctgtcttgaaagtcccaaccagtgatacggcttacatttcattggccatccccactataaggaagtctgggaaacatcaactggcacattgctgccccaagtaaaatcagagttctgttagaagggaagaatgggagaatggatttggggtatgcaactagctgtgcctgtcacagtcgttcatatattaaatacacttctaaacaattattacatttgatgtttttttcccaagtagtgacacaaaaggacacattacaaaaagattgtgatcttgtgtccataacctctccttcaaaacactggctccgtaaccaaaaacaacctaaatttctattaagttcatattgaatctttttttttttttttgagacagagtttcattcttgttgcccaggctggagtgcaatggcgcgatgtgggctcaccgcaacctccgcctaccaggttcaagtgattatcctgcctcagcctcctgtgtagctgggattataggcatgtgccaccacgcctggctaattttttgtatttttagtagagacggggtttctccatgttggtcaggctggtcttgaactcccgatctcaggtgatccaccctcctcggcctcccaaagtgctgggattacaggtgtgagccaccacgcccagcccatattgaatcttttctatatgatttatttcagccttgtttatttccatctattactgccttaagcaatgggtgacacttttattatccacccagtttgtcaagaagtatgaatttaaccaaaaattgtgcctcaaacttactgttttaagatttaataaatgcatgtgtgtattgttaccattcatagttaaaaatgcttttatttgtttttttatttgtttgaaacagagtcttgctctgtcacccaggctagagtgcagcagtgtgatcacagctcactgcaatctcgacctcacaggctcaattgatcctcccccactctatcctccctaatagctgggactagaggcaagtgctatcatgtgctatctaagacgcatgtgctaactagaggcatgtactgtcatgcccagctacgttttgtattcatattttttgtagagatggggtttcaccatgttgcccaggctggtcttgaactctggactcaagcaattcatctgccttgtcttcccaaagtgctgggattacaggcatgagccaccatgccctgccccaaatgcttttaaatttaaaactttgaaaatttaaaccaaattaacatatgcacatggatttaaaaaaaaaaactcaaaacagtatagaaaagctggtgataaaaagcaacagctaccatatcctgctccagtttccaaccccaaatcctgtatattctataaaacaaccaatttgaccatttatttttaaagtcttgtggtttttatgtcttttgttatgtatatactatgtgtgtttgggccataatcctgaaagatacaattccaaacgccataatcttgcatgttgaaattccaaaacatcaaaatccttaaagtctaaaatcccccaaatcacagttctgaaagatcaaaaatcccaaaaatataatctggaaaaaatcattcaaagagtatttaaaatactaatttttggccaggcacggtggttcatacctgtaatcccagcactttgggaggccgaggcgagcagataaccagaggtcaggagtttgagaccagcctggccaacatggtgaaaccctgtctctactaaaaatacaaaacttagctggagatggtggcaggcgcctgtaatcccagctactcaggaggctgaggcaggagaattgcttgaacctgggaggtggaggttgcagtgagccgagatcgtgccattgcactccagcctggggaacaagaacgagactatgtctcaaaaaacaaaaacaaaactagtttttaaacatattaaaaaggggattcaggctgggcacagtggctcacgcctgtaatcccagcactttggggggccgaggtgggcaatcacttgaggtcaggcattcaagaccagcctgaccaacatggagaaacctggtttctactaaaaatacaaaaattagctgggcatggtggtgcacgcctataatcccagctactcgggaggttgaggcggaagaattgcttgaacctgggagaaggaggttgcagtgagcggagattgcaccactgcactccagcctgggcgacagagagagactccgactcaaaaaaaataaataaataaaaataaaaaggagatttatttgagaaacatttaaaaacacaacggaaacttcataggccagtttgcagaagaagataggtaataataacgtatgtatttttgtgactgtacacactgaggtgtactgatgacagtcacataggtgtaacagttacgagaagatgaactatattcataaggaagtaggtctaaaagcaaaatatataaatgcatatcactatagttggtaattctgtgcaaccagttttgtaactggtcatctgacataccttgatggacaacctaagtcttttgatgagattgatcaaaaattgtgacggatcaccactgtatatgcagtcactcaaaaagccaggatgtcaagaaattttatctttcacaaatgtacgtatacaaaaaggacatctcttcattcattaaggaagtttcaacattttttacatacatacacaatactaagtcagcgttgtggtgacacactcatagagtcaaatttgcaaaaaaaaaaaaaaaaaaagcataaaacaaattagaactctaaaactctttacaaagtttatgcttctggccgggtgcagtggctcacgcctgtaatcccagaactttgggaggcctaggcgggcggatcacctgaggtcaggagtttgagaccagcctgcccaacatggtaaaaccctgtctctactaaaaaatgcaaaaaattagccaggtgtggtggtgtgcatgtgcctgtaatcccagctacccgggagggtgaggcaggagaataagttggacccgggaggtggaggttgcagtgagccgagattgtgcaactgcactccagcctgggtgacaagagcgaaactccgtctcaaaaaaaaaaaaaaaattgacatgcaaaaaagtatattacagtgaaagattataggcagttgcatggaggtagtccataagaattggccaacttttcacaatcattatctatattttgaagtcttccttcatgatgaatagctgctttttttttttttttttggacatggctctttttggaaaatacatttacatccgtattctacatggcactgctctttttgaaattcttctatgatttgatatacactgacataatcatcccctattaaggttttccatcttcagtgctatgcttctatgttttgcatacatggaaattcattctgcatgcactcatatacagactacaaatttagtgcagactatacttgtgatcaaacaacaacaccgttatatgtcttgtaatcctaccatgcacataattatttttaaaccagtcagtaactttgctggtttcttcaggcaaatgcagattcaatccattaaaagctgggctgggcgcagtgactcacacctgtaatcccagcactttgggaggccaaagtgggtggatcatgaggtcaggagattgagaccatcctggctaacatagtgaaaccccatctctactaaaaacacaaaaattacaaaaatacaaaaaattagcccggtgtggtggcatgcacctgtagtcccagttactctagaggctgaggccggagaatcgcttgaacctgggaggcggaggttgcaatgagccgagatcacaccatgccactccactgcagcctgggcaacagagcgagactgtctcaaaaaaaaaaaaaaaaaaaaagcttctggaatttcatcacctggaaggaaagccaatgcagacaaatgacacatttttaaattgaagttttcatcattgccatatctcatggccaatcgactcatctaagttttccactaaatgcatcagactgaatggaaaaaataaactttgttagtgacatcttgaaattcactttcagaagctttgttgcacctaatctgtcattatgatttggggattcagttgaatccattttcttttgcaacatccaccaaatcttcaaataagtgttttataaagtgcttcccttttgtccagtcattcatacataaatgagtggataagttctagaattttgagatccaacagggggatgaatcatatgcaattggcaaaaaatggtggggatggttttgaaagtgccacacattagccaaactgaagcatgcactggtttttctttgttagattgggtggtttaataaatagaagtctatcttctttgatggacagatccctgatcaagaatagttcatcatttaacgtgttttgtatcactggaggaacctctgtatcagcaagtgcctttcattcagaagttcactgagcttttcaaattccattttttttttggctggaggtagtggctcatgcttgtaatcccagtgctttgggaggctgaggcagttggattgagtgaagccagaagtttgagactagcctgagcagcatagtcagactccatctctacaaaaattttaaaactatccagacgtggtggtgtgcacctgtagttctagctacttggaatgttgaggtgagagaattggttaaggccaagagtttgagaccatagtgagctatgatcacaccactgcactccagcctgggcaacagagtgagaccccatctctttaaaaaaattccttttattctccgatgaaggttattttttttccttttccccccttttttaaaaaaaattcagttggcacaaaggaaggattttttttttagggcaagcgtggtactatgtgtgaagatgcggaagtcatacacaattgaataatttggcaggggagatttcttgtatcttttgcctgcattttcacttctctgaaacactcaaaacactgagggcagatcttacccacttggtctactcagactcacagtaatctctggaaacacccttacagacacacccaaaataatgctttatcaggtttctaggtattccttaatccggtcaaattgacacctaaaattaagtccacaaatccagccctggtcaatttggcacccatatgtgtctccttaaaccataattcacttccaaataaagacaataacaaggtaatagttctgtttaacatgatgcagctaacatgatgcaaatattatgcacacaaccaaacaggtactaatcgtatccccagaattaggctttctagattttatcattcagaattttaatctttcaggattgtgattttcaggattttaatcattagggattttagactttagagatttttaattaaaatttttatttttctttcagaaatgaagtcttgctttgttgcccaggctgatctcgaactcctgggctcaatcaatcctcctgcctcagcctcccaaaatgctgggcttacaggtgtaagtcaccacacctggctgactttagggattttgatctttcaggatttcaacatttaggattatagcattcaagattatgattggcactaatactatgtatatgcctaatgttatgtatatgcataatgtcaatttaggcattattagtaacttcttgctatctattatagtatatatactatctattatatataatagatatgtactatggagatatatgtgagcattaagcatgtatgtctacatatatatgtgtattatatattcagtcattatatattatcactgtgtaaagttctactagaatcaacatagaattcttgagattctttccagaactttgaatgcagtaaattgagcatcatcactttgaaagtaaacttaaagtctaataaatatgattatatgtatattcacaatatacattaacaataaatataatatataatcaatatgttaatattattaatgatattatattataaatgtataatacatatataataaagatatataaaaatttatatgataaattattataggatagttaaatatttcacataaatatttatcagctggtttttaaaaattcatttattcaacaaccatgtgccaagctctggtctaggtgttggggacacagtggtaagtaaacaagacagaaaaattcctgttcttatggaactgacaatctactataaagataggaaatcaaaaagtaaacaatgtatgtgcaagaaacatggggtgcattgctgttttagataaatttgttggggaatatttctttaaggaggtgacatttgtatggagggataaataatgggaaggagccagtaatgagaatatcagggggaagaggattcaggcagaaggaatagtcagtacaaaggctagggggcttggcatctttaaggggccaaaggaggcatatctggctggaatggggtgagtaaagaggagagaagtaggatatgaggtagaggaattagggggctgtggcaaccagaatacatttcatttccagtgtagtgggagcccctgtgggcttttaagctggggaaggaaatgctttgatttttagttaagaaaaggaaaccatgttgggtgctttatggagaatacactgtaaggggggcagaattggaagcagggaggctagttaaggaggttcttgtagtagatgagttgaaagattatggtaactttaagtatataaacattatcacccattcttctagacacagttggaacagaattaaactatttttcagtaaatcttcagtaacgactggggcctagaaataatttagaaaatgagtacaatgcatgggtttgaatatttaactatgcgtggtatccagatatgccctgatctcaaacctcgggcctttgagcatgctctcctatctgtaatgttctactctcatcatactaatttttgctcatcattgaagtctcagctctaagacctgtttttcaacaagccagccctaaaatcacccaagagtgattgtctgtcatgtagctgtcttatgaactctaatttatatctaggcttatggattttacagctccaaattgtccattattttaattgccatatttaattgccagtttacttgtccatctttcccactagattgtaaactcttagatgcagggactgtgtcttactcatctcattctttgcacttaaaattagacaattgaaaaatgtttgttaagtcaataatcaatgtttaactgtgtgcctattagatttacctgagttacctcattcttagattatgttagtgtgaataaaatattacatcaatagattggagcaggtaatttccttaacactgcaacacatagtggaatatctgtgtttgattccactttaaaaattttctcaaaccccatcaccataggctaatggtctttgtcatcatcaatgaatagatggtggaagggctgctcgagattcgtaaatgttgaaaggacgttgctcttcactgaggggcatgttgtcagtttccctctttgggcagctccagtatttctactagtaagtggtacagatggagggagaaatctacgtgacaggctgcctaggctgtgccaatgtcaggtccctttagggtgcaggaggggagagttgcctttttatcatgcatggttttttccatgtaattcgtctgacttgtgaaaaaaaggtgaggcaacaatgacatgcaaatacatgagttattaccaacaccaacttgaacagtgtgatggagcgtgcatcagatctgtggtaccctacgagattttaattttctccttttgatgcaattcttacctgaaatataaactcttttcaaatctctcccagacctttctttaagggggagtcagccattgcttctaaactttagtgggcataagaattgcctggaaagcatgtgaaaacagattactgggctccacctgtagcatttctgttccttggaggaggggcccaagaattttattttctgaaaaaaactctcaggtgctgctgtttcatggactactctttaaataggaaagagatggactacgtgtttctaatttctgtttactgccattgcaagtgctttctcttttcataacgctaatattctggcctgttagcggttgaggaactcagaggggaatatacacaatacaacctagaccaaaactttcagtctacttacttggtcagtgtcttactgtgttctgggatccccttacccttatgataaaaagacgcacacttttgcctgcacagtgcagcttgtcttctctcctgttttatctctctcctacctggtctggttgacctgaagtttctggaattttctgctaattccttttatatctaccagctaatgtcttcccctccatctatataacagattgcctttctgattctctttcagatcaatatgtcccactcatcattcctccacattgaacatctatctcttgaaatatttttatagccctataaaaactccatttgtgatactatcctgtcttcattgctttgctgcttttttttccttcatacttgttgggtaccacagtatactaccatcaggaaactataaatctgcttacaaaactgcataaaatatctaagctactgatgctttcttctgtatcctcttaaccaggcttaactgctgtatgtagaatcaataccttttggactctttggagattgatccatccgctgtgacttcccagtgtattttttcccaatgtattatttttcaattgagatagaatataaattcagcaacattcaccttttatagtgtacaattgaatgattttttttttttttttttgagactgagtctcgctctgttgcccaggctggagtgcaatggcatgatcttggctcaccgaaacctccgcctcccaggctcaagtgattctcctgcctcagcctcccaagtagctaggattacaggcacccaccattatgcccagctaatttttgtatttttcttgagatgggatttcaccatattggtcaggctggtcttgaactcctgacctcaggtgatccacccgccttggcctcccaaagtgctgggattacaggtgtgagccaccacacccggcccaatgaatttttaacaaatgcatacagtcatgtaatcctcaccacaactgagatatagaacagtcccatcaccccgaagttcttcaccccccattgtagcactctcccctctactcctggcccttggcaactgacaatcagttttctgtccttatagtttgccttttccagaaagtggagttacacagtatgtgtgagtctggcctctcttacttagcataatgcatttgtgattcatacgtgttgttgcttgtatccctggttcattcctttttattgctgcagctgcatgctattccgttgtgtggatctaccacagttgtttatctattcccaatgttttttaattgctatatcctctcctctaaatttaagcactttttttttctgtcatttggcttttgagtacgaaaaagtaaatttccaaatttaccatgtgttctaggtagaaataaaaactaagttgcaataggtactaataagctctgaatttctgcacctgatacattcctgatgtttctttacttaggcctattttaaccaactctcaagtaggagcccagatgtggggcatatctataccaaagaagcctgttctaattcatccttttggatcaagagttttccaagttgcaatttgaaggactgacttgagatctgttatttagggtcattgctgcaattcccaggagagatgtaagaaggccttccctttcactaaaggggtcccataccataaatacatatccctgataatttggaaccagcctgtctcttgtgtcacccccactctagggcccagttctctatgtatcaatatttggttctagaccacccaaggtatgaagtcccatagtattcttgacctctgtctgagatgagactcctatagttttgcaggctgggtaagcaaagtataggataccatcatagttggccaatatagaacagcttatcatggtctagatagggaaaacataaccaagaccaatgatacttcccagcctacatggttcaaagtattaacataatgtaatctacactatagagattctaagaatcatttccatttcagttagtttccattagtacttaggcttcagagctagggacagtggctcatgcctggagtcctagctactcaggaggcgaggcaggaagatcccttgagcccaggagtttgagggggcagtgagctacgattgcatcactgtattccagcctgggtgcagagcaagaccctgtctctaaaataaataaataagtaagtaaataaataaataaataaataaagaactgaggcttcagaagccaagttatggtcaagcatatcatttcataagtttcattggttctataactagaaataaaatacacaaatgttttattacatttaaatttgtatttagtccttacattttaagaagatatcttaaaagttgaggacagctaaattttatgccaagtatactcaactgtacctgtaataactattttgttttatttagcatttaaaaatagaataaatatgtgcttcagcattttatttatttggattcagcagaatattactatttttctccaaaaagtcttccttttctcttttcattttaaaagaaactaattttcaaaaacactttctaaatatattcagagtaaacattttatttatttcatttacttaccacttaataaatacaggggttcccccttgttcttgggtcgggatgcagtccaggaaccccagtgtatgcctgaaactgtggatagtgtagaaccctcgatatgctaagcatttatcatacactgtggccataacttttacaatttgaggtataacagcaaaactaacacaaatttcttcttccttcttcacagtttcatggacagaagattgtttttactttagatcttagcagcgtcagcatacaatgtttttctttccttatcaagtcgagaactttcaccttttcacttagaggaagcactttatggtttctctttggcgcatttgccagcatcactactctcgtgcttcggggttcatcattaagtaaaataagggttactcgaacacaagcactgcagtaccaccaagtcagtcgatctgataaccaagagagtgtctacagtgtggatctgctggacaaagggataattcatgggtgggacagcatgagatttcactatgctactcagaaaggcattcaatttaaaacttatgaattgtttatttctggaattttaaatttaatattgtaggaccacagttgatggaggattaagtgaaactgcagaaggtgaaaccaaggataaatggggaccacctagataaaagttaagtcaggaaacatataaccttttaaaggaggacaagctgacaattctttttatctttcttttatacaggtgtttgcttcagaatggtaagtcagtacaatctttattattttgctattttttttccactgttattcccaattacagagatagggcagttttctacttggcgctagtctactgtttactccctgtccttgacagcaaatgaagaaatatatgtatttctttgaaattactgattgagatttttattaatgctaaaaacattgtacccttcttagtatttacttaacattttctatattcaaaagtacctctctttgggtgattttaatgaaacgctttgattaggtgtattgaatacaaagtatgggactttctacatgttctggatggaagaaatcctctaggcaacggtacatatgttgcactgcaaaacaaaacacgctaatgttgcataatgaagtggttcccaggatttagcagattaagcgccacgtcgtgttttaaaatttatttatttagtttggagacggagtcttattctgttgcccagtctggagtacagtggtgcgatctcagctcactgcagcctccgccttccaggctcaagtgattctcctgcctcaccctcccaagtagctgggattacacaggtgcctgctacgacatccagctacttttttatttttagtagagatggcatttcaccatgttggccaggctggtcttgaacttctagccttaagtgatccagccacctcagcctcccagagtgctggaattacaggtgtgagccaccatgcccagccaagctaattttttttaacttttagtagagacagggtttcaccatattgcctgggctggtcttgaactcctgacctcaagttatccacctgccttggcctcccaaaatgcccatgcctggctccatgttgcttttaaatttttaatttttttaaagtactcctttcctacaacttaattgtggcatgcattttcacctactatctgaggtgggtcactagattaggtccctggttcccaactcctgagggttccaatattttcccactggtaaaatctctattatgaggcagccccatcccccaaaattcagattgtctccattttcgttattatctaataagaaagtgacttattttcagggccacgtcttacatcagtcttagctgttaccattttgatttgtgttgtttcatacagctggggatgtggagtgtagagatcttgatcaccctggcctccatacaggagaagagtatgtttttgaaaagttctaaggccggatgcagtggctcgcgcctgtaatcccagcactttgggaggctgaggcaggtggatcacctgaggtcaggagttcaagaccagcctggccatcatagtgaaaccccatctctactaaaaatacaaaaattagctgggcatggtggcagatgcctgtaatccgagctacttgggaggctgaggcaggagaatcgcttgaacttgggaggcagaggttgcagtgagccgagatggcgccactgcactccagcctggacgacaagagtgaaattccatctcagaagaaaaaaaaagagttctagtagactggatcaatagaaattttagtatgatgtagttaaaataattcaaaatcaaaatgttgctacttacatagcataactgaatttggagctagaaaaaggcaattttaaaagactattaataataataggagagataaatctacccatagacaattataacatttctgtgccaagtccagagccaacagaaaacatcagaatcttttagtcttataaaaactctgcaaaccagcatgtttatgttagtgttcttgctagtttaattttctttcttttttaaaaaaaaattattttaggttcagcggtactcatataggtttgttatataggtaaactcgtgtcatgggggtttattatacagagtatttcatgacccaggtacaaagcctagtacccaaaagttatttttttctactcctctccctcctcccactctccaccctcaggtaggccccagtgtctgttgttcccctctctgtgtccatgtattctcataatttagctcccacttctacgtgagaacatgcaatatttggtttctattcctgtgttagtttgctaaggataatggcctccagctccattcatgttccttcaaaggacatgatctcattcttttttatggctgcatggtattccatggtgtatatgtaccacattttctttatccagtctaccattgatgggcatttaggttgattccatgtcttggctattgtgaatactgctgtagtgaacatatgtgtgtatgtgtgtttatgatgaaacaatttatattcttttgggtatatacccaataatggaattgccgggtcacattgtagttctgtttttagctctttgaggaattgccacagtgctttccacagtggctggaccagtttgcactcccaccaacagtttgtaagcattcccttttctctgcaacctggccagcatctgttattttttggctttttaataatcgccattctgactggtgtgagaaggtatctcattgtggttttcatttgcatttctctaatgattggtgatattgagcattttttcatatgcttcttggccacacatatgtctacttttgagaagtgtccatgtccttgcctactttttaatggggttgtttataattttcttattaaaatgattttccctcatttttgctggaaatttcgaagtgttgtagtctctatttctgcttatcaatactctatgttgatcataattgtatatgttttttctcagtgattgagaatcttggattgattatgatttggaacccaggttaacaatgtaatttagtgttagcagtcttaagggcaatgcagctaaattttatgtatccaaaaacacatcataggaactgtttctgaaataattctcactctcagcgtagtttttcataatgtttttatgatagtggaattgtttttactgaaagtgaaatttaacaaaagataccatttatgtgaaggttcttataagtagaggttactgtaggtcatctatacaattgttggcattgactacaaaaaatgattattaggttagcattttttggatattagaatcaagtatgttatgaactcagacttttgatgctgcactttattcttcttgttttttcctgaaacagtatacagaagatgaagctaggaaaataggagtggttggctgggtgaagaataccagcaaaggcaccgtgacaggccaagtgcaggggccagaagacaaagtcaattccatgtgagtagtaaaattaataacatgtacatgaaatttatgaggctgctgttttttagttttttaagacatggtcttgctctgttgcccaggttggagtgcagtggcacaatctcggctcactacaacctctgccttccaggctcagatctccccgactcagcctcccaagtagctgggactacaggtgtgagccaccgtgcctggccttataaggctactttaatgtttcattggacagtaagaatagtattgatggaccagattttgtttgtagattacaatcaaactaatatgtttgtaggcaggcctgtgaagaaattctcagagttgggagtagcatttctatgtttaggaatggacttcccacttgggctggcctcgagaagaattgtggcttccctctccaatttgtatgtcctgtggcatctcctccagcgttagggagatgtccagggcccaagtaattctcatttgaagtgttgtgacagatgcgtagtgccttaggatggttcgtgaagttcttagggtagcgttccaggcaaaaagattgccatctcctttttacagttaagtgctttatttatctaattgtaattttatttttcctgccaatgagagtgtgtttaatgagctggagggttaccaaactatgaatccttgaagtccaagagaggccagattcagtaatatggggaaaaatgtcctgtgtacacaatgacgttttcaaaagccttgtgttttcagcttcataatttccactgctctttgtagtcttttttcttttaaattaaaaaatagctaacatttattgagcatttacatgttgggcaatatgctaagtaccttgtatgaattatctcaatcttcacaacagatcttatgaggtaggtactaagtaacactcaatttattttattgtttgcaatttatctttgttttcattacttaatatttttagatttccaaagcaataggttttgcttattgtaataagtgaagtaacgtaacactgagaagtataaaggtaaaacttgtaatgtgtacttttctgtctatttccctcccctttattaacctctgacaaggaatactttctacagctttctctttcacttaaaaatagttaagtatgcatttgtaattaaggttttgctgatttttaccgaaatagaataccttgtgcatatttttccataatttgtatttttattttctggacatttcagtaaacagtaaatatataattatcaactccttatttttctaattttaaatgtttacgtgcatacttgtgtttgtgtgtaaaactacacctcaaattgaaaagtggggtccaaaagttcagtttcacaaactgtggggtgacagttaatgaaaaacaatatttttaagtagaattgtcacaaaatgtacaagaaattttgggactttcgttgtacagaactgatagttcaatggaagagaaaatgccaaatgattgtgtggaagttttaaagtagagattatgtcccatgattcgagggagcctagaaaaaaataataatatagtttttaaaaacggggagtatgtggaagatagaagctcataccaatcatgtcatattcctaatccacattatagagggtcattgattaatttgcttaacataaatgaaatcgtatcatacactgtgctcatgttttcttttcaacccctgcattctccacccttcttaagtaacctgtgttagcaagctagtgtgtattcttctgcttgtctccatgttcacattctctctctcacacacacacacacacacacttgcacacacacacttttatggattttgttcaatatttgctttttaaaaatgggatcacggtgtattcccttctctgcatcttactttatcactcaaagatacatccaggaaaatcctttcaagtcgaatggtaatctctaattcattctttttattggctacttaatattccacaatatatagatttattattaccttattgctggaaatgcatttttttctgtcttgttttttgcaataagagcaatgctgcaataaaattttattggtgattttattttgattgcataggttcccaggagtgtgatttgttggttgaagtggctatgtatttttaatgtaaaaatatttgtcagactgctttacaaaacagctgtaaacaatttacattgttttcctcctcatcctgtcagcaattggtattgtactctctaatttttcttttacctgattggttgtgagtgattattattttttgctgtaatttgcatttctctaatgactagtaagttggagcatctttatgcttatgtctgtgaatttgttctcatgaactcccttttcacatcctttacccatttttctatcgagttgcttgtctcttgccaatttttaaaagctctttgtatattggttatggttactaacccattatctgttattgcttttgcaggtattttcccaaatctataatttgcctattggtttcgtctatgatagctttgcaacataaattgtttttcatttttattaactcaaatatggctatttttttctctctggttaagaaacagattgtaagtgttgtcgcccaggttttcttctaacttgatgctctatttattacatttaagcatttactccatctggaatttgttttttatttaaaagatgagatattggaccaactattttctaccagatgaatagccagttgtcctggcgccacttactaaataatcactctttcccccattgcattgaaatacatttttgtcatacgttaaaatctcatatagactggattttatttctgaattctctattctgttccactgatctatttctctgttcctacatcagtataccatattgatttaattatactatctccacagtatatttcctctcactgttctttttgattcttttatttgctttcttgggcatttgtttcctctcttaactttaagatacttttacctatttaactggaattctattctgtttattaaaaagaaaacttacatgattgtgtcacacatatgcttttaagataaactttatgtatttatttattttttgagacaagggtcttgctctctctcctaggctggagtgcagtggtctgatctagactcactgcagccttgaccttctgggctcaagtgatcttcccacgtcaacctcctgagtgcacatgctggctaatttgtgtgtgtgtgtgtgtgtgtgtgtgtgtatattttgttgttgttgttgttgttgttgttgttgttgctttgtagagatagtgtctcactatgttgctcaggctggtataggactcttggcttcaaatgactttcctgcctcagcctcccaaagtgctgggattacaaaaataaactttatttttgagaacagttttatatttacagaaaaattgtgaagatagtacagagactttccatatactccccacacagttttcctcctattaacattttacattaatatgatacgtatgttaacaattaatggaccaatatggatacattagtattaactaaaatccctatttatttagatttcaatttttacctaatgtccattttatgtcttaggatcccattattgtatttgctttttaattgggcattctcttgaaattaagagaagtgacattttggctgggtgcagtggctcatgcctgtaatcccagcacttcgggaggctgaggcgggcggatcacttgaggtcaggagttcaagaccagcctgtccaacacagcgagatcgtgtctctacaaaaaatacaaaaactagctggggttggtggcacacgcctgttgtcccagctacttgggaggctgaggcaagagaatcgcttgagtctgggaggcagaggttgcaatgagatgagattgcaccaccgcactccagtctgggcaatgggagtagcctgtcccaaaaaaaataaaataaaataaaaataaagacagaagtgacatttttatgatattaaatcttcccatttaagaacacacagatgttgttccatttgcttagattttaaaatttatccttcagtatgattttatggttttctttatataggtttttgtacttttcttgctaagttatttctaagtatcttaatgactttttcactattgcatatggatttctttcccatttatgcttctagttgttcatgcttaaatatggaatatctaatgacttttgtgtattaattagatatcatagtattaccttatcagatattcttattaattctatcagttttttaaaaaactatagtctattgggtttttaaaaaatacagttatgcaattagtaaaaatggtgtatctttgtttcagtgacttcatttgtcagacctgccatgacaatgttgaataataatagccatagcaggcatgcctgtttggtttctgactttatttaaaatagttttattgtttcacctagtaaaaagatgtttgctgttggttttaggtaaatatactttatcacaataaattttacttttgcattccttgaattagcctttgattggttacagtgtgttattcttttaaattattgctgaattgccaagtattgcttgccaatattttatttagaacttttgtatatatataagtcacgtaaggtttttgttttgttttgttttgttttggtggagtctcgctttgttgcccacgctggagtgcaatggtacgatcttggcttacttcaacctctgcctcctgggttcaagcaattcttctgcctcagcctcccgagtagctgggattacaggcatatgccaccactcccagctaatttttgtatttttagtagagacagggtttcaccatattcgccaggctggcctcgaactcctgacctcatgatctgcctgtctcggcctcccaaaatgctgggattacaggcatgagccaccatacccagccggttttttttttttttttttttttttggggggggggtattctatcatgttttgattttaaagttttattggcttcacaaaacatattaggaagttttccatccttctcttcattctggaataactaaaatatcagaattactgttcttaggttagtggaaacaaattaggaaatcacctggtcctgctgccttctcaatgttgacctttaaccaccttttcaatctaccctgtggtaactggtatgtttgttttttgagaaaacgttttgctctgtcacccaagctggagtgcaatggcacaatcacagctcactgcagccttgacctgctgggtttaagtgatgcttccatctcagccacccaagtagctaggaatacaggtatgcaccaccatgtccaactaatttttaaaaatttttttgtggaggtgaggtctcattacgttgcccaggctggtgttgaacttctgagctcaaacgatcctcctgcctcggcctcccaaagtgctaggattacaggtgtgagccactgcacccagcaagtaactgatatagttgagttttccagatgttcttggattcctttttattttgctaggaaattatccaatttttctaggttttcaaatttgttgcgataaattttataatttaaaaaatctcggccggtgcggtggctcacgcctgtaaccccagcactctgggaggctgaggtgggcagattatgaggtcaggagtttgagaccagcctggccaacatggtgaaaccccgtctctactaaaaatacaaaaattagccaggcgtggtggtacacacctgtaatcccagctacttgggaggctgaagcaggagaatcgcttgaacccaggagccagaggttgcagtgagccaagatcatgccactgcactctagcctgggctccagagcaagactctgtctcaaaaaaaaaaaaaaaaaatctcttttgcatctgtgcttatatgccctttgaaaattcctaatcttgtagaacttcattttctcctcctttttccttaatcaagctctgacagaatttatctacttaattggtatatttttaaaaaacagcttttagatttattgattataatttttgggagggttacatttcattaatttcaacttccatctttattaatttcctcttctttctttgtttgttgctcctctaagtcttcaacatgagtcctagttgccgttgtttttagttttttaaagttaataatgaaggtgattaggcattttctcctgaatacagtttttttcttttccattggttttggtagtaattgttccttccttgctttctggatagtttgtaatttcattttttatttcttctttgaactaatactgtaactaatgggattctgagtttgtgtttgtaaaattcccagttaaaacttttaaagtaattgtttattatttatttctatttttatttgattataatctgagaacgaggcctagaagatttctacttaaaaaattttgttaaatccttgtgataaatgacatgatatattttggattgatcagctaggatctatgattaaattaggatgctttaggctgcaagtaacaggatacctgattaaagtgcttgaatgaaggaactgatttttcccactttccaaacaggctggggcaagcagtcctaggattagttcagtgtgcgaaagattattaaaatgtacattttggtgttgctatacttttctctttttatatttttttatgatgggattttcaaacacatacatgaatagagaaaaaaggacagtgaagctcatgtgcccattacccactttcaataacagtatgctttcagacattcttgtttcatatattcctccaactttttttttgtcattgttagagtatttaaagcaaatttccggcattatattattcacctgtaaatttggtcaaatgatattaaactatcaatacttgacaatattttaatctataaaacaacaatttcatgttgttcaatctaatgtttgactatatacagaaaacagaaactctatatatccatcaatatgtattccaaatcccacacagatctatgtgcaaatgtcaaagtgcatcacacaacctgtctgtcatgctttttcctggaggcctgtcttccagtctgggtctgggtttgctacacaactgtcactctggtgttgctcttcgctgctttcctgtagagcaggctcctgtgtccttaatcatatgttttaatcattcttgatttattctcttattttgcagaaacataattctctataagcttccgaaggaaaggtgcatgagaggcaaaaagtttgcatctctgcatgccttcatttacccttgtgcttgactgattgacttacaaaattctatgccaaaaataatctcacactaagaattttgaaggcatagttccataacttacagtgttgctgttgagaggtttgatgtcattcgaatacaaaggattgggagttatacctgtttattccctcagaaagtttgtcagatattccacttatctctcttctccattttcacaaccatctgcctttgtgcatgttttaattttgctgtaaatgcacttggaggagaatgttttttctttgacaatttccttccctatctcttttggaccctcttcttttagaacttctgtatggacctgatcctctatttttttttttttttattacagactggattttaccctgttggccagtctggtcttgaacccctggcctcaagtgatccgcctgccatggcctcccaaagtgctgggattacaggtgtgagccaccatgcccggcccctgattttaaacttttctcacctagtttccatttgttattatgtgggaaattagctcaactttgtcttccaacctttctattatttttgtttgtttctgctgctctatcttaattgtttctctttcatagcatctcattcttgttgttgttttccccaaatctctctgaggatattatgtgtatctttcttttcaaagtattcttctgatttttgcattgtctctttttttttttttgagacagagtcttgctctgttgcccaggctagagtgcagtggcatgatctcgcctcactgcaacctccacctcccaggttcaagcagttctcctgcctcagcctcctgagtagcagggattacaggcatccaccaccacacccagctaatttttgtatttttagtagagatggaggtttcaccatgttggccaggctggtctcaaactcctgacctcaggtgatctgccagcctcagcctcccaaagtgctgggattataggtgtgagccaccgtgcctggctgctttttgcattgtttctatttcttctaagttacttttcttttctttctcttcttctttccatttttctcctgtttgcttgttttgcttatcttttatattgccggctttccttacaatcatattttcagtaacttagtcatacataaatcaaaacagccaacaataagcaggacttaaggaaattttccaatatgtagacttatgggcttgaggaatggtggtgactgggtggggaactggcatttttgttagtgaatctccaaatgtcagatctatgcgttctgtcttctgcagtggtgtctccaaatcctgagtcttctgtgaggtccatgggggtaagctgacttgcttctcattatttctgtaggcacttagtctgtaacatcctttggtttactgtatagttactccttctccacttgctttccttctttctttttgtttttaggcaggatcttgctctgttgcccaggctggagtgcggtggctcagtcatagctcactgcagccttgatctcctgggctcaagtgatcctcttacctcagcctcccgagtagctaggactgcaggtgtgcaccaccatacctagctaattttttaattttttgtagagacagggtcctactatgttgtctatgctggtcttcaactcctggcctcaagtgatccttctgcctcggcttcccaaagtgttgggattacaggcgtgagttaccacacctggcccctctgttttcctactaattatttgttgaaacctcttgtttaggttatagttttgtaccagctaggaatattttcagctataagttaacagaaaactggacttaaaaatggatataaaaaaagggttcatttttctcagtaataagaagtttggaggcagatggttactggccttagttcagtagctcaataatgtctggaccaatgtctctgtggttgtcttggccttttcctcatggtcaaaaaaggaaaagtgcagctgcacatgatatccacagttaaggcaggaacgagtaaaggattgtgttgcttttcctgacccaccccaaacagatatctacttgtgttccattggctcaaatagggtcatatggttactccttgctacaagggagactgagaaattggcttggttttttgatgccctgaaaaaaaaattctcttggccaggaagaaggggatggggatgggtgtatactaggtagtcaatgaacaatctgttacatctttcatattttgatgctatcattttaatggggcttcaggtgaaagaagatagacatgccatgtgtaattgcatggtgaaaattaagcgagaaaatccatatgaagcacttagtgcagtgcctggcatgtagtaataatcaataaatatttgctactatgttatgacccatatgctccactttgtacatgttgtctcgtggcagttggaatgatcaggtggagatgccactaggctcctagataaatgggtcatccctgcagagaaattgggctagagaaattaatttggttgtcatcagtatgtggatagtgtttgaagccacatacatggatgggattatccagggagaagttgtgtaatgacaagcaagcaggaagaagacactggagaatgtaaattaagcttaaccaacattataagttgtgatgttacatgtttaggttttaaaaaatgaatttattcctctagtgcaatatattaaggtactgaattatcaagaaattgaatcacaataagagatgttgcaaaaatagttgcaaagtcagactcagtgtggcacatttgtagctatatattaggttggtgcaagagtaatggcaaaaaccgcaattacttttgcaccaacctaatagtgccagtccaggaacggtggctcacacctgtaatcccaacactttgaggggtgaggtgggtggattgcttgagctcaagaattcgtgaccagcctgggcaacatgatgaaaccccatcagtacaaaaaacacaaaaattagctgggcatgggccttactttcttatagctatttttaaaaagagaaaaattttttaaaatgcaatgacagtaagttgcagaaatctgaattaaattgcctttaaaaaaaccacatttgtttcttcccaggccatgaaaatgtggaatacaacagggaccatcatttagagatggcctggctgtgattatagcagccctgctctgtctttactaacaagccagcagcatgtaagaacacactgtggatgtgtgtgttttcttcttctgtgttttattttctcaaaaagaatgactgatgactttcttttgcaaattgtactatattattccaattgcagtggtaagttctgccaacattttttgatgcataaggactgttttgaatctattgttttattatgtctttttttttgcaaaattaagaatattttctgtttcttagtaatcatgttaaattaatgtacagtgttatgacactgagcataagcctttgaataagtcctcagaaaatatattttccataaagactcaatggtagttttgtaaaataaaacacttgtatttggagatagccaaattctaaaattaaaattacatcttgattgctacatattttttaaaccgtatgttatgtatcagtcctctgcacttcaaaggattattaaaggactggtatatgtatataagaggatgatgaaatggttacatggcctggaaaactatgtcataatacaaggaatgcttgaaggcattggggaatttagctggagaaaaaatacttgaaatcatgatagcttccttcaagtatttgaagggctgatacataggaaagggtaaatgttctctctttttccagaaggcaataatcttgattggagccatgggtgaatttgctgaatttgcttatttcagctgaccctgacaacaagttttcctgtaaagtcattaaatgtatataatggtggaattttatcaatacctaggagtagtctagatcagggattggcaacccacggcctgttttgcaagtttagtaaatgaagttttattggagcacagccacacccatttatttatgttttggctatgactgcttttgtggtacatgggcagagtggagttgttacaacaaagactggatggcctcaaagcctgaactatttaccatctggccttctacagaaaagggtttgctgctcactgtataacagctgtcagacaagccgagggtgttgtaggtctaactcatcaaatggtatgttagactagatgtcctctgaggtcctgtccagctaagattctgtgtttcttttttgtttgtttgtttgttttttaagacagagtttcgccttgtggcccaggctggagtgcagtgccctgatactcggctcattgtagtctctgcctcctgggttcaagcagttctcctgcctcagcctcctgagtagctgagattacaggcgtgggccaccatacgcagctaatttttgtatttttagtagagatggggtttcaccatgttgtccacgctggtctccaattcctgacctggggtgatcggcccatctcggcctcccaaagtgctgggattgcgggtgtgagccacggcgcttggctagattctgcgtttctttcttttttttttttttttttgtgagacggagtcttgctctgtcgcccaggctagagggcagtggtgcaatcttggctgactgcaagctccgcctcccgggttcataccattctcctgcctcagcctcccgagtagctgggactacaggcgcccactaccacgcccggctaattttttgtatttttagtagagacggggtttcactgttttagccaggatggtctcgatctcctgacctcgtgatccgcccacctcggcctcccaaagtgctgggattacaggggtgagccaccgcgcccggcagattctgtgtttctatacagagctgatgattgcgcatgtacttaaaatgtgttcatagttcaagagttagaattagaatagagatactcactaatagagttgtgtttacctcttccatagatattaatacttgacatttgtgtgaaatatgaaatttgaacacctttctgccttaactatgaattgacatttttttgagtttccagttgtgacaatggtaaattgaaatgcaacaatggattttgtgaacaattaggtggtgtcagattcaaagttatttaatattttcaaaaataacttttctccagcagaccattagtggcatgaatgtctgtgcaaccagagtggctagcttttccttgctttttcatctgagtatttcaaggtactttgctaatatttttatactttattcatcaagttcctttttacacaaatagacagggttattaagaaaggttccattggatgttctattgaaacatagaaggtatttttttaggggaacaaaattcactgaggagctgtaattttggaaaaagaatagtttagtctaattgatataaattactctaatggaaaactaggaacatgaaaaatatctacagtagagttggaattctaacaccaggctttagacctcaaatactaaatcatttattttcctttagaacataaccgatctatattaaaatgacttaagggtatagtttttactttaaagttcatattttatatatgtgcatttagtaaggtaatcatatttaataaaagaaatgcataatgcagtactaattactttttatctttttttctttaatcagctttctcaggtagcaactaattacttaaaaaaattaatagactttcttttttagagcagctttaggtttgcagaaaaattgagtggaaactacagagagtttccatatatttcctcacacccaattccctaggtccctcagtttcccccattattaacatcttgcattatgtagtatatttgttacaattgatgagccaatattgatatattattaataactaagctgataggttacattagggttgactctttttttttttttttttttttgaggcagagttttgctctgttcccaggctgctgtgtaatggcatggtcatagctcactataaccttggactcctgggctcaagtgatactcctgcctcagcctcctgagtagctgggactaaaaacacgtacatgatgctcagctaatttttttattctttattttttgtagagatgggatctcgctatgtttcccgggctggtctcaaagtcctgggctcaagcagtcttctcacctcagcttcccaaagtgctgggattactggcatgagccactgtgcctgtccagagttcacttgtgatgttgtacattctactggttttgataaatgtatgatggcatgtgtctaccattatagtatcacagagaattgttccactacactaaaaatcccatgtgctctgcttattcatccctccttctctccctctagcccctgacaaccactgatgtctttactgtctccctagttttgctttgcccagaatgttatatagatggaataatatagtatatattttcacattggcttcattcacttagatacatgtctttaaggttccttcatgtatttttatggcttgacatttcatttcttcttattgctgaatactattttattgtttgggtgtgccacaagttgtttatatattcacttattgagagacaccttggttgcttccaaatttgttattttattaatttttttagagatagggtctttctgtgttgcccaggctggtctcaaaacctggccttaagtgagcctcccacctcagcctttcaagtagctggtattacaggctcaagccaccatgctcagctggtttcttccaagttttgtcaattatgagactgattacttttttaaaaatgtattttttcaaaattataatcatatataattatagggtacacagttttccccctatgttttcttatagtatgtttttaaaatcagtttcaggtcttgtgtttaagtctttaatccatttcgagttgtgttttgtatatggtgtgacataagggtcaaatctcactcttctgcatgtggatgtccagttttcccattattctttattgaagagactgtctttgccccatcgtgtgttcttggaacctttggaaaaaaaaaaatcagttgactgtaaatatgtgggtttatttctgggctctctatcctgttccattggatgatgtttctatttttatgtcagtaccatgctgttttaattactacagctttgtaatatagtttgaagtcaggtagaatgttgcctccagctttgttctttttgctcaaattgcctgggctacttagggtttttttttttttttcatgtgtgtgtggttctatataaatttcaaaataactttttctatttctgtgaaaaatgtcattgaaatgttaatagggattgcattgaagctgaaggtcattttgggtagtgtggacttttttttttttctttttttttttgagacagagtctcgctctgtcacccaggctggagtgcagtggcgtgatctcggctcactgcaagctctgcctcctgggttcacaccattctcctgcctcagcctctcgagtgcctgggactacaggtgcctgccaccacacccggctaattttttgcattttttagtagagatgaggtttcactgagttagccagaatggtctcaatctcctgacctcgtgatctgcctgcctcggcctcccaaagtgctgggattataggcatgagccaccgcacctggcccgtagttggactttttaacaatattaattcttccaatccatgaacgtggaatatccttatatttatttatgtcttcttcaatttctttaatcaatgttatatttttcagtgtacagagctttcatctcattggttaaacttattctcctaaggtttttttttttgatggctgttgtaaatgagactgttttctatatttctttagatagtctgttgctagtgtataggaatgctactgatttttgcgtgttgactttgtattcttcaactttactatttatcacttctaacagttttttggtagagtctttatggtttttgtcatcagcaaacagtgacaattttaagtttttcctttcctatttgaatgccttttacttctttctcttacataattgctccacaaggacatccagtactacattaaatagaaatgatgagagtgggcatcctggtcttgttcctgatcttagagaaaaagttttccatttttcaccattgtgtgtaatgtttgctgtgggcttttcatatatggcctttattatgttgatatacatttcttctatactaatttattagtgaaaggatgttgaattttatcagatgccttttctgcatctaatgtggtgatcatatagtatttgtccttcattctgttaatatggtgttctccatttatagatttgcatgtgttgaatcatctttgtatccctgggataaattccacttgatcatggtgaatgatccttttaatgtgctgttgaatttggcttattcgtattttgttgaggatttttgcatctatgttcatcagggatattggcctgtaattttcttttctcataatgttcttgtctggctttggtatcaaggtaatgctaacctcataaaaagagttcaaaagtattacatcctcttcgattttttggaagagttcaaaaaggattgatattagtttaaatgtttggcagaattcatcagtaacacttccagtcttgggcttttctttgatgggaaagtttgtattattgatttagtctttttgaattaccaattcaattattattggtctgttcagattttctatatcttcttgatttagtattggtaggttatatgtggtaggataaattctaggaatatatccatttcttctagattattcaatttattggcatatggttgtttgttcgtactaatctttatgattctttgtattctgtggtataaatcacagtgtctcctcttttatttctcattttatttatttgaatcttttcacttttttttctaggttaacctaactgtaggtttgtcgattttgtttatcttttcaagaaaccactgctggtttcattgatttttcttctattgtttttctagtctctattttatttatttttgccctgatctttgtcatttttttccttctgctacatttaggctttttctttttctgcttccttgaggtataacataatattatttgtgatatttattcttttctgatagactgcaggggtccccaacccttgtgacctgttaggaactggaccacacagcaggaggtgagtggcagtaccacctgagctccacttcctgccagatcagtggcagcattagagtcttatagcagagcgaaccctattgtgaactgcgcatgcgagggatacaggttgttcactcttcatgagaatctaactaatgcctgatgatctgaggtggaacagtttcatcctgaaaccctacctgcttccttcctgtcttccaccaaactggtccctggtgcatagagccatttattgctataaatttccctcttagaattgcttttgctgcatcccataagttttggtatgtgttgtgttttcatttttgtctcaagatatttttaaatttcgcttttgatttcttctttgactcattggttgtttagtaacatgttaatttccacatatttgtgaattttccaagatttctcctgttactgagtcctagtttcatagcattattatcagagaagatacttgaaattatttcacttctcttaaatttgtccagactagttttgtggcctaacatatataataaaggtatatatttttcatttattaaacaattatatatttgataccttttatatatgccaggcactgtttttggtacctgacctagagaaagttccatgtgctcttgagaagaatctgtattctgttgctgttggatggaaaattctacatatgtctgttaggtccatttggtctaaagtgtagctcaagttcaatatttgcttattaattttgtttattttttatgtaatcttaaagtttacctacaatataaaaactttagcatgaaatatatatatattttatttaagttccaggatacatgtgcagaatgtgcaggtttgttacataggtaaacgtgtgccatggtggtttgctgtacctatcaacctatcacctaggtattaagccccgcatgcattagctatttatcctgatgctctccctcccctgctccccaacaagccccagtgtgtgttgttcctctccctgtgttcatgtgttcttattattcagctcccacttacaagtgagaacatgcagtgtttggttttctgttcctgtgttagtgtgctgaggataatggcttccaggtccatccacgtccctgcaaaggacatgagttcatttctttttatggctgcatagtattccatagtgtagacgagcatgaaatattttcattttcttatttatgtattcatttttattttttgagatggaatcttgctctgtcatccaggctgtagtgcaggggtatgatctcggctcactgcaacctccacctcccgggttcaagcaattcttcctgcctcagcctcccaagtagttgggattacaggcacctgccacccatgcctacctaatttttgtagtgttagtagaaatgcggtttcaccatgttggctaggctggtcttgaactcctgacctcaggtgatccacccgcctcggcctcccaaagtgctgggatttacaggcatgacccactgtgcctggtctgagcatgaaatattttaaataaatattttttaaaaaggtatctcaattttccaaaaacttgaaatctattttagtttaccagtacaaaataaatgtgatttaaaaaaaaaatttacacaagatttacatggttgtcctaaaatttaaatgatgtggatttatgtggagtaaaagatgtaagttctttctgtcctcttaataccatagtcctatacattttttcctatgcatgtaacatgtatatatattgaaaatacatgtaatataatcccttattattttaaaaaaacctatacattcccatgtagttacatttatctctgtcatttgtgaagatgggatcatgccacacatattattctgcaacttaaaaaaatttcactgtattgtatattgtggatatcttttgatggcagtgagtgttcttttaaatcactgcagaatattcagatttatagacaaattataatttatttaatcattcatctattactgggcattcagctttctgcagtttttttgctattatgaatctcgttgcagtgagtatccttgtatacataatatgtgtatctttttcatttattaaacaattatatatttgataccttttatatatgccaggcactgttttaggtactagaattcagcagtgaccaagaaataaggtttaatttcttgtgtgggaagacccacaataaagaaacaataaacaagatacaagatactttcaaatagtagtaagtgccgtgaaggcaataaataaggtcttgcagaagagagtggtggttttccaattctagatggggtaatcagggaaaggctttccatggaggtgacttctaagctaagagatgcatggtgaagaggaggctgtcagtgcagagggtctgggaagagctttctgtgcagaggcaacagcaaacagccatgcaccagtgcaggtagtgggatcatctgcctggtgcaggcattatgggcacattgtatatagggaatttgaaaacaacaggaaaaccaactaaaagttggcctgcttttctttctttcttttattattattattatttttttgagatggaggctcactccagcgcccaggctggagtgcaatgacaggatctctgttcgctgcaacctctgcctcccaggttcaagcaattctcctgcttcagcctcccaagtagctggaattacaggcacccaccaccacgcccagttaactttgttttttttttttttttgtatttttagtagagacaaggtttcaccacattggccagcctggtcacgaattcctgacctcgggtgatccacctgcctcagccttccaaagtgctgggattaaaggcatgagccaccgtgcccggcctgcttttcttattttttttcctctttttgcccttattttatttttgtagagacggggtctcactgtgttgcccagcctgttgtcgaacttctggtttcaagcaatcctccagccttgacctctcaaagcactgggatgacaggcatgagccactgcacccagcacggtctgcttttgattatcaccatgcaccagcaattctaaccaataaaatactgtgccttatttccctcccgctccatgccactgacatgagatatgtgctattccccatatttttgaagtgttgattcctggatatgggtcaaaggctgtctgcaatttaaatttaaactttggattcacttttaattataaaaattatcaagtgtttttcaaaacatactgagtaaactaaggcctcgtggctgaggaagttttgctctcttctgtgcttttgtaagtaaaaaaattgtattgatttaagtaatttaagtgaatcaagccaattacaaaatattaagaaatggaaattaaataaaatcacccataaacctaccgtttgaaaacaaatttggacaatattttgatgcataatgcaagtttgtatttctctttctcttttttggggcaagggtcagctaactaaacatttggtttgatattcttcagagttaggttgtaactctctatatatacatagttgtatatatactctctctatatagtatataggcttactactataaaaccatgtgttataggtttactactataaaaccactcctggttggcccttcgtctgtggcaggtacttttgactgggctgctaaagtcaagctccctgggctttaaaaaaaaaaaaatcctcaaaaatcagtcaatactgcctgagatcacctgttttaactccaataaggttctagagcaagcatctcattcggtcacgtgaaggtggcatacctgggtggtggtggaactcagttgcagaactgggcttcaaaaatattcataagtcagtgcttatattggattatgactttttaggatgcttttttttttttttttaatgagacagggtctgactatgttgcacaggctggtcttgaactcctgggctcaagcaatccacctgcctcggcctccaaaagtcctgagattacaggcatgagccaccgcacccagccaggatatttttgaatagttaaagtattttatcatgataatgttttcattcagtaaatgtttattatgtgtatttcgacgtccctctgctaggtgctaaggggcataagatgattaaaggggttgtgaaaagtccagtctaactggggtgagagaggtaggcaggtaaattagcacaggttggaagcacaggggtagagtttgggaatgaagctctggggcagcacagtgggaagagtgctcctcctgccttggggaacaggacaggccttgcctctccttctggcttcctctgtcactattcatctcgcaggcttttctgtcctctgccacaagtgctcttcctccctgaggacttttgcagaagttctttcctctgcctggaatggatgcttccttcttgtctccacgccttgctgattgctccccactctttcattccccacttgctgtgttgtagcccctcactgtgtgctctgcttcctgacatcatttagcacggctgctgtgaaaggatgacttgctggatattccccacctccccctcaagagaatgctttcagctgtaagtaacagaaaactgataaacaagtggctcgacaaatggtggtttattctcaaatatataggggactggaggtcagtagccactggtgcttgttgagctgtcatcagtgtcaggatcgtgtctgtaggattctcttgtcctttccctcatggttataagatggctgtcccagcttcaagtgcacccacactcaaggctgggggaagggatggctctgggtcttttcctttttatctggaaagcaaactctttcccagaagctggcagcacacttctatgtgtgtgctattgtccatccctggcagtaatcagctttttcagccactcataaggatgaaagggagaggggggagaggtattaagactagtgttgtgtttgccattcaacaatgccatctacacttctcaagactgtaagctccttaaaggcagggattgtctgtccttttcttctttgaattcccagtgccttgcacagtacctggcacatagagtgaatggtgacaagcatgtcagaaagagaaggtggaataaggacctttcaggagaagagaatgtcagatacgaaggcattgagctgaaagagccttcattgtgtttttgggaacatgtgactggaacataggcagatgacagactactggaaactgaaaagctctgcatatcatgtgaatttgtccttctgtcagcaatggggagtcgttgaaaagtttcaggccagggagtgacacaatagtatttgtgggttagattactgtgttgaaaatatgggctaagaactggaagaagggagattggaatcaaggagattaattaaccatatcatactgtggtttcatcaaagagagtaagaataatttggaagattggaaaatataattttaaaataacctagaacaatgatctcaaagtaggaccttggatcagtagcatcagcattacctggcaccttgttagaaacgtaaattcttggggtccacattgagcctactgaatccggagcccagggtaagttccagcagtgtgagttcataagccctccaggtgactgtgatccacatgaaagcttcagagccactaaactagagcaatggatgcttaagggtgaaagacagcttggagatcacccaatctgatacagccaatctgcatatcagaatcacctggggagcttttacatggcaactaaattgcccacacctcctactccacacagcagaacaactaaatcatgatcttgggggctgggacccgtgcatcaaattatttccaatgatctcaagtgtttccaatgagcagccaggtctgagtaccattggtcttatctaacccctattgatgggaaaactcaggattcaaagaggagttactcaagggcgtatagcaagctcaggtaagaactgggtccttgaatcaatttcataagctgtcatctccatgaatgccttaaacactatcccaactttttaatttttaaattatattaaaaacttttgtggctacatagtaggtatacatgttctatcctaactttttaatgatttgcctgaagataatcattcacggtgacaaatacaactgccaaatttttagaagaaaaataggttacagacattatgaaaaagtcagttctcttttacatgaacagtattacacactttaaaaagttatcctttttgtaaatattttgtaagaatacgtatttttaacaataatgaaaagaatatagatacaatagggtagagagtgctttgttatttgtgtgtataagtaataacccttttttcaaactctagatggagctctttggtttttatatattcttttatttataatttggtaagtctttgttttaaaagaagcagctattttgggatttttttaaaaacattaaaaattttataataagtattctcaacatttctcagctctccttttcttgttgtttcacaaccatatagattcttacttttttttgttattgttcaattgctggaccaaatccaaattcaggcctcagagagtcatttctcaaatgcatcttaaagttgtattttatctcacagtatttaacgaatgggataagtttcccatgtttattgtttgtaataggtctcaaagttgtaatagaatttgtgtaagatggacctccctttatgaataatgccaggagagaaagtctctgaggatattatagctgttgctatagtaattccttcagctatttttaccccactgtgtacaaaggagtgttaacagctaccttcttgtaacataaatgaaacattttgctgctgcttctttttcttttccgttttactagctcagtattctctcttctattggaagtgcacttggagcaaaattcccaaaatatgaggcctgttgtttttaatggtataagcctgtggtgtggttcctaggccagcagcagcaccatggatatcacctggaagtttgttagaaatgcagattctcggctcccaccctagacgtactgaatcagaaaccctggggatggggcccaacaatctgttttgaaaggctgttttgaaaggataaaaatcctgtactcaccggaacctacataaaaaaatttcctcctgtacaggccaggcatggtggctcacccccataatcccagcacttttggaggccagagggggaagattgtttgagcccaggagttggagaccagcctgggcaacatagggagatgcccatctcaacaacaacaaaaacaacaacaacaaaaaatcagaaagttagccgggcgttgtgatgcacacctgtggtcccagctgcttaggagactaaggtgggaggattgcttgagcctgagaagtcaaggctgcggtgaatcgtgatcaccgcaccccagtctggagccagagtgagaccctgtctcagaaaagaaaaagaaaaattactctgtacagtcacttttgctcgttttggatttgtccagtgcttttcaaatcacccagggcttttgttaaaaggaataattttcattcagtaagtttgaggtggagcctgatattctgcctctaacaaactcccaaacagtatggattttgcttgtccccggatcacattttgagtggtgaggccaaatagcacatagtaaggccataaccatgcctgcatgtgagttatctgtgatttatgtgtatatgcttttgatttagtatacctaaagtcagtttttccttttcaatcacagtgggaagagacaatttatagaatgtaatgctttcttgtctaattgtaagtgactcaatcatattaaatgctacaagagggtattgtttgccaggatctgtctctgagaccctctgttataatcagcagtggacacccttgaaaattacattatttaaaaaactgagactcattcatagcattatgaagtcagagagaaagtcctgaagtttgaagaagttttcagacaaaataatttcagacaaaaagaagtggttcataaatgtttgttatcggctgggggcggtggctcacgcccgtaatcccagcactttgggaggcctaggggggtggctcacccaagggcaggagtttgagaccagcctggccaatgtggtgaaaccccgccactactaaaaatacaaaaaattagccaggtgtgttggtggatgcctgtaatgtcagctactagggaggctgaggcaggagaatcgcttgaacccaggagacagaggtcgcagtgggccgagattgcaccattgcactccagcctggccaccaagagcaaaactctgtctcaaaaaaaaaaagttatcattcacttattatttactgagcatctgccgtggggagcattgtgctaggcactttaggaaatttttttaaaaaggataaagtccttgaccttgaggagataacagtctagctgaggcaataaaacttatgcctgtgaaagttaattaccaaaatagggagtattctgtcaaatggtaaagaagcgtggtagaatttcggaagaccaaaggatagctaatggctggtaaggctgaaagagggatctgattagggctttggagcatgtatagaacttagacattcagaggagagggaaggtgggggaatgctccatggaagagagatggcatgggtcagggtgaagcttctaggagtgaatcatggatgcacacaggaactggggagaagttcagatgacatgaatcttaacttcttgtctaggagccagataggtgaggatttaactgccaggcttttgagttttgacttagtcccttgtgcaccaaggaatcattgaagaatgctttcagctgggggcagggtgacccaatcataatgatgatttaggaggagtcattaatggaatattcaggatgaattcaaatgacagactggaggctgaaacacttgttggtaggcaccggcactgggtacatagggaagagagaagactgcaggaaatacagtaaggaagagaactggcaaagggacaatataaactgaaaatataaacagattaatgagaagttaagaaaaattaattcatatgaatggaaaccaggggtgtttgggaccacatttgtccttttgaggtgcctcttgtggcaaacagcgtttttttgttttgttatgtttttgtttttagttctgggatacatgtgcagaacgtgcaggtttcttagataggtatacatgtgccatggtggtttgctgcacctatcaacttatcatctagtttttaagccccacagccattaggtatttgtcctaatgctctccctcctcttgcccctcacccccgtgacaggcctgggtgtgtgatgttcccctccctgtgtcatgtgttctcattgttcagctcccgcttatgagtgagaacttgggatgtttagttttctgttcctgtgttagtttgctgagaatgatggcttccagcttcatccatgtccctgcaaaggacatgaactcattcctttttatggctgtatagtattcaatggtgtatatgtgctatatttttttttatccagtctcttattgatgggcatttgggttggttccatgtctttgctattgcaagtagtgaaacagccttattttctaactaaccatcttggagacactgtatagactagttgatttcagtggcattaccttgctaacgatttgaagttgatatattatttcactcacatttacctttttggttttgtatctccttttagggtcctctgccttatttcctgcaatcatgaatatgttttgaatactgctagtcacaaattccaaagctggccattcattgttagttagtactttcagaacaattgtcttaaaattttagatctagaagggacctgagaggtcatctggtctgtctgtctgtctgtctctctctttctctgtgtgtgtgtctgtctctctctgtctctctctctttcactctctctctctctctctctcacacacacacacacacacacacacacacacacacacattagagacaaccaaagtcttctaagacttgaggcaaaggaaagtacacttgaaggcaatactatatgatgccccatccatgttaagatggttcacagagctgatctgacctgatcattggtgccttagactggagaggagactgggtgccaggagagcaaaccagtcttcctgttagtttcttccctacccctgccccaagggaaagtcagtgcatcttggactctggatgaaggaatcttctggcggaaatctaaggagtttatatatatctattttaaatcaatgattaccggccattttacagagggttatctctctaaaagtcctagaaacccatgtaagcatattgaatcagagctattcagcctgacttgttgcagaaaacatactgccttaatccaccaaaacacacacatgtgacactgcattctaaaagtttgaagttttacattcagtttaaacaaccatccagcaatatcagaccctggtccattggcttagtggtgcctcattcttaatgctcttatctaggtgcagcctcaattactgcctggttagtcagtcaaggaaaccaaagtgtgtgcgctccacttgaccatggtgttgtcagagagcacccagagggccatgtagtctttgatacagcatgaggtgatgcatttgattattacctgtgtcctctgggcaagcatttattcattccacaaatattataaagtatctgctatatgtcaggcagagtgttgggaactgtggatacaaagatgagtaatacagtctctgccctcaaggacttgaggaaagatggatgggtagacacagaagaatgtgtatacagaatgaagtaagacatggaggatttgatccagaaaactcttgagactgaataaaggattttaacttttgtacaaactgagatcctcctgtttgccctgtcaatgccaaggcgacctacattcagatactgtgactttaaaaaaattgctcattatcatgtccacatctccagtttggctgacacatctgtccttgtgaaatatgccaagcacaggataagataatctctgaatttggacccagtcaagtgcttgagttcgatgccaagatggttaggctaccttgctactcaccttgaagatttctcataatgatggaaacttacttcaagattctatagcaatttggcttttgtatccccaccttccaagccccccacctccatttcttagtctcacatttgccaccccagttcgctggcaatgctcatctcacaaggctaacagatgcagctcacaagccaggagggcagcaggcaggccctcttgataaaggactcttaaaatttattttaatttttctttttttgtgtgaggtattttccagtgaaaaccagaaaacctgctggacaaattctgaaaaagctgtaacttttttttttttttaatgcttcaggcaattccatttgatctggccatcaccaaagctactggtaatccataggacccttcctcatgacggcatctatcgacctgtgaccttttgcctccagctcttactgaacaaaaaaagcacccagtgtatcaccactcatttcctcagcagtctgctatatttagtttgtcaaagtgtttttggatcttgattcagttatctaacatgttcattgtttctcctagctcatcaactgagaaatttgataaggatcatttctatatcattgtccaaataattgaggacagctttgaacagcacagggcccagtagcacagtctagacaacactctcctctgatacatttataatcatatctgaaaagatataatggtggcaatcttttggacactgtattacaaaaaatctcaaatccagagaaaagacagagaatagcgtaatacccacatttagatttcacagttgtagtatttttctatatttgtatcacaaatgttatatagatacagatttttttttctgatttggataaatttgctgtaagagacatttgggggaggaactactgaggcatttgaatatggcctgggtatgaaagaacgttaaggaattagtattatatttgttatgtgtgatatcatcatggttatgtaggaaagtgtctttattttttatagctgtatactgaagtatttgggtgaaatgttatgatatccataattttatttaaatactttgggcttttataaacaataattcagagggaagagagttgtgtaggagatatctaaagaggttcagagagaatggctaattgtttatcagtctgtgatggaattgttttgagtttggaatattttgataagttctaaataataagccagttttaaaaaattaccacataatatgaaagacagaagtcttcatcctgttcttgggcccagtgccaccccagagcctcattccatcccatttctccatcccaattattactgtcattttttataaaaattgcttctatattttgatgtacatttctcaaaactgttttgtcaaaatattcactttttccattgtcttcagacaaaaccactgtgtcaaatctgctgtgtccaggccaggcacagtggctcacacctgtaatcccagcactttggtaggttgaggtgagcagatcacttgaggtcaggagttcaagaccagcctggccaacatggtgaaaccacgtctctactaaaaaaataaaaaaatcacccaggcgtggtggtacatgcctgtaatcccagctacttgggaggctgagggaggagaatcactgaaaccgggaagcagaggttgcagtgagcagagatcacgacattgcactccagcctgggccacagaagcagactccgtctcaaaaccaaacaaaataaaatagaatagaataaaataaaataataaaataatctgctacatccaaatgtccaataaaggaaaaaagccacatgaaccgtgagttagaaaccataaaaagtaattggatattaccaagagaagtgttactaatataatttcagatacattacggggataatatttagacaggtgtagtagagccattattgttatatatcagctgagttattttaaaatagatatagtaatcattgaattaaagaaacccaatgaattttaaaaagagaaagagcagtgaaaatgaacatacagtatctcttgggaaaatgtaaaatggatgataaaacaggaagactgtagagggtgtattatagataacacattaattgtaattgtattagaaatagaattttaagcattgccattttctggatagctgaggatgacaaagtcaaaatttttagtgcatgctttcacttaaatggcctataaaatagacaactgaggtgaaacactggtaagatgagccaaagctttatttttggcgtcattttcctttaaacctgttgggatttgtaaagcttggttttcctgtccaaagaaccaatcaggagtgttacagaagaatttttctacctaaataattttgaacgctattctttctaaagtatgttagacttatcgcttacctttttccccacagaatggaagctatttagcagaggttggcctttttctgatgactccagtagatagtttcagcagtgaatcttccagggctaattagcatgtgtggtgccattggagttgcatgcttgcgttcttgggtcctggtgtgttgttcctctttgttaggtctgtctgattttgatctgtttctttgatgcttggagcacacccatgagagcctcccctatccccctttgacttcagtttcaaatttatggacattactgaaataaatacacacatgctcaccttcgtttggatcctacatcaaaaaatgtgataaacaatcctcagcctctagaatttttttttttaagagagaataggtcttgctatgttggccatgatggcctcatgcaaccctcctgccttgggttcccaaagtgctgagattacaggcatgatccacttcacctggccaacctctaggaatttgatgtaagtctagctactacctaccagccatatccatgtactctagacaacatttttgacaaacagtgcacaggaaaggcccatgaaacttacggttttttttccatcgagaaaaatattgccttctatttctataagttaattttatttttcaataattctaataattaatgaaataatacctggatgctaagagtcaaacagtgctaaaaatatttaaaaaccagcaactactgcctcttcaacccatcccatcccactcctcaacaatagttttagcgatttttttgagtattcctcctaatttcagattaactggtatctcttaaatcattaactttagatattatctggtgactttttaccgtgatagacaaatctattgatgtcctattatgatagatgaagatgtgactcttaaactagtctttccttccctcatttcctcattatgcttttatatgacttttggttaatgcatcagcagtcagtttttatatttttagaactatgtaagttgtgtcctaaggtgccctcaaggaggaatctggctccagttgttcatttcttctttttattttgagacagactctcactctgttgcccaggctggtgtgcagtggcgcgatcttggctcactgcaacctccacctcttgagttgaagtggttctcctgcctcagcctcccgagtagctgggattacaggtgtgtgtcaccatgcctggctcatttttgtattattagtagagacggggtttcaccatgttggccagcctggtctcgaactcacagcctcaagcagtctgcctgcctccgcctcccaaagtgctgggattacaggcatgagccaccacgcctggccagttcatttcttcttttagcgttttgtgacacttggtgatacttggttgccaataccaggtgatagaaaaactttacctccaaatcctgttgcagaaatttttcttaaaacagtttttttttttttttaaaatcacagaatagacacagtctcttaggcggttggaagtatattcacatctccagctagatgggaaaatcttgtgggcagggattgtaatatgactttgggattgtaatatgacttcgtaaagaacagggatttttaaaaggaaaggttaagatttggataggcaaaaggaaggaggatatgctttatacttttggtctcttgaccttatctgaaggcctggaactcctgtaatgaagtagttacacagtcaaaggtgggaggagggtctgttagcatccatctgcaggtctcagtaattctccactgcctgacacaatcacctcctcactgcccctgtgaggtgcagcgccatccaagtcaatcacagggaaatgccagggctcactttgtttatttactggagtggctggttgtactgggaggctatcaagactatcgggagggctcggcatttcatactctttgggctgccttctgtgtgtatgtgacagatcctgggccgggatctctgagccagagctcctctcaaggttaaccttgtacatccccctccccatatgtgatcagcaggggacaggctggagtgcgcaagccggagtgcacattcccaaaggttcacgctggccttccttcgtgtctgctgtccagccccaaatacgacccttttaatctcataaaactactcagaagggcttcaaacataaagaaatacagtccacagctttcctccccatactgaagatagcgaatggaatatgggaatgttatcggggggcgagctgttacccatccactaagagccctagttcctgatggccaaatgcatatcttctctattaagcaaatttatctgccaaaaagctgtgttatgccaaaaagttatgtccacaaatttaggacactatcttgtgtcgtttgtggttgtataagaatcacaatgtggcgttggttgctaaatacattattaacctgtttgagagcaactctgttgttttctttgctcatgaaggtcaattttcaccagtagaagcattacaaatttaacttgaggatcttagtttttttttcctgtaagagcttttttcacccctttcattagtaattctaaaaattttgaactggaaattttaataatagagtaagtaaatctaagcttctttggaagttgtacttgtcagttctatttttcggtgtcttaggaaacaagttaaaaacggctttttagttcttaatacatttctaattacagttctttctcctctttaaggggcttgcttttctttaaaaaggtgccgttttctttccctgtactaattggaatgttggttttaaaaattgatattcttgggttgggtgtggcggttcacacctgtaatcctaccactttaggaggttgagggaggaggatctcttgagcctagcagtgcaagatcagcctagtcaacatagggataccccatctctacaaaaataaaaaatacaattagccaaggatggtgggatgtgtctgtagtctcagctactcaggaggctgaggcaggaaggatcccttgaacccaggagtttgaggctgcagtgagctataattgtgccactgcacttcaacctgggtaacagagcgagaccctgtctctagaaaaataaaaattatattccttctaaccatggtcattaaaaaaatatgtatataaatatacacatgtatatatatttgcttgcaaagagacaaaagtcattacttaaggcaaagcttttaaaattgaagatgtttcatatgatcatgtgctttgtttatgaacacatttgtaccaactgaagtgttggccttggttgaatttccttcttttctccaaatcatcaaaactgatgaaatgtcaatcatgttgaccaatttttcacaacaatgtgtgtaacccatggcagtgaagggtgtgaagacaaatttagcttccacacctggagagggagcagtatgtggatgagtagaataaattgaactctactaatctcttttttcttttatttatttattattatactttaagttctagggtacatgagcacaatgtgcaggtttgttacatatgtatacatgtgccatgttggttagctgcccaccacccactgacaggcccctgtgtgtgatgttccctgccctgtgtccatgtgttcttactgttccattcccacctatgagtgagaacatgtggtgtttggttttctgttcctgtgatagtttgctgagaataatgtttcccagcttcatccatgtccccgcagagaacatgaactcatcctttcttatggctgcatagtattccatggtgtatatgtgccacattttcttaatccactctatcattgatggacatttgggttggttctaagtctttgctattgtgaatagtgccgcaataaacatatgtgtgcatgtgtctttatagcagcatgttttataatcctttggttatatacccagtaatgggatcgttatgtcaaatggtatttctacttccaggtccttgaggaattgccacactgtcttccacaatggttgaactaatttacactcccaccaacgtgtaaaagcattcctatttctccacatcctctccagcatctgttgtttcctgacttcttaatgatcgccattctaactggtgtgagatggtatctcattgtggttttgatttgcatttctctgatgaccagtgatgatgagcattttttcatgtgtctgttggctgcataaatgtcttcttttgagaagtgtctgtttatatcctttgcccactttttgatggggttgtttttttcttgtaaatttgtttgagttctttgtagattctggatattagccctttgtcagatgggtagattgcaaaaattttctcccgttctgtaggttgccttttcactctgatggtagtttcttttgatgtgcagctctttagtttaattagatcccatttgtctatttcggcttttgttgccattgcttttggtgttttagtcatgaagtccttgcccatgcctatgtcctgaatggtattgtctaggtttttttctagggttttatggttttaggtctaacatttaagtctttagtccatcttgaattaatttttgtataaggtgtaaggaagggatccagtttcagctttctacatatggctagccagtttttccagcaccatttattaaatagagaatcctttccccattgcttgtttctgtcaggtttgtcaaagatcagatggttgtaggtgttatttctgaggcctctgttctgttccattggtatatatctctgttttggtaccagtaccatgctgttttggttactgcagccttgtagtgtagtttgaagtcaggtagtgtgatgcctccagctttgttcttttggcttaggattgtcttggcaatgcggactcttttttggttccatatgaactttaaagtagttttttccaatgctgtgaagaaagtcattggtagcttgatggagatggcattgaatctataaattaccttgggcagtatggctattttcacaatattgattcttcctatccatgagcatggaatgttcttccatttgtttgtgtcctcttttattttgttgagcagtgatttgtagttctccttgaagaggtccttcacatcccttgtaagttggattcctaggtattttattctctttgaagcaattgtgaatgggagttcactcatgatttgactgtttgttattggtgtagaggaatgcttgtgatttttgcacattgattttgtatcctgagactttgctgaagttgcttatcagcttaaggagattttgggctgagacgatggggttttctaaatatataatcatgtcatctgcaaatagggacaatttgacttcctcttttcctaattggataccctttatttctttttcttgcctgattgccctggccagaacttccgaccctatgttgaataggagtggtgagagagggcatccttgtcttgtgctggttttcaaagggaatgcttccagtttttgcccattcagtatgatattggctgtgggtttgttacaaatagctcttattattttgagatattttccatcaatacctagtttattgagagtttttagcatgaagggctgttgaattttgtcaaaggccttttctgcatctattgagataatcatgtggtttttgtctttggttctgtttatgtgatggattacatttattgatttgtgtatgttgaaccagccagccttgcatcccagggatgaagcctacttgatcgtggtggataagatttttgatgtgctgctggattctctttgccagtattttattgaggattttcacatcggtgttcatcaaggatattggtctaaaattctctttttttgttgtgtctctgccaggctttggtatcaggatgatgctggcctcatgaaatgagttagggaggattccctctttttctattgattagaatagtttcagaaggaatggtaccagctcttctttgtacctctggtagaatttggctgtgaatccgtctggtcctggagttttttttggttggtaggctatgaattattgcttcaatttcagagcctgttactggtcttttcagagattcaacatcttcctggtttagtcttgggagggtgtatgtgtcgaggaatttatccatttcttctatattttctagtttatttgcatagaggtgtttttagtattctctgatggtagtttgtatttctgtgggatcggtggtgatatcccctttatcatttgttattgcgtctatttgattcttctctctttccttctttattagtcttgctagcggtctatcaattttgttgatcttttcaaaaaacaagctcctggattcattgatttttttgaagcattttttgtatctctatctccttcagttctgctctgatcttagttatttcttgccttctcctagtttttgaatttgttagctcttgcttctctagttcttttaattgtgatctcccaaagtgctgggattacaggcatgagccaccgtgcctggcctgtttttgcttttttactgtaaatttactgattatcaaactaatacatactgtggtagaaactgccagttatttcccagcatgcatctgtccccttttttctttagtaatagaaaccctgaacttgcgctgtacacatggtccctactatggtctgaatgtttgtatccctccaaaatcatatgttgaaatccgttccccagtgtgatggtattagggagtggggccttttggtagatgatcagatcataagggcagagctctcacaaatggggttagcacccttataataggccttggagagctctcacaccccctttaccatgtgaggatacattgaaggcaccatccatgaggaacaggcccttatcaggcactgaatctattggtgcctcaatcttggaattcctggcacccagaattgtgagcaatatgtttctgttgtttatataaagtacccagtctaaggtattttgtttagtagcccaaactgactaagacatccccctagcataaggaccgtatttcttagcctgtttgaagcttgtatggccaccaatgagatgtgaatgaaaataatgcatgcattgtctcggttatgcccttaaagggaaagggtgtgccctccactattttctttcccctttcttgccagaatgtgaagacaggaattggagcagccatcttgaactgtgagatggaagccatacattgaaggtggcagagcaaccaaatagaacgaccaagtgtctctgatggttgttgagctgtcataccagctgtggactgctgtctgaacttttgtaggacagaggaatacactatttaagtctgttgtaacacctgaattgctctgtattctaatataatacttgttttagaacacttggaacaacagaaaattagttttgttaaggcaggaaaaatcttatgtgtaattctatcacccagagtcagtcatgtgttaactgacatcttagtggatgttgtagcatgcttccctcagcctcatccccacctctaccttcacgatgacatgcttagttgctcagtgcctggagtgttagctgctaatggttctatccaggaattgaccttggcctcaggggggcagcctgcatccaagaatctgttgttgagagggtaccaaagtctagtcttcttgctttattcagtttggacaactctgaagggccatcctagctctagagctcgatgtagaagtggccaaggtctctgttgcaactgcattacagttcacctctccctctgtcaatccagcttccctctcctttcacaggcactcttcccaagggcacttcacaacaaacccgcatgcaaatctcagaatctttgtgctagggaacctgacctatgacatatacagatttagagatttgggattataatactttgtttttcactaaatattttgctgggtagtctccatttgcctttccagacacattctcctgccctccatccacctctgttctgggaggctgaccacgatgggatacattaatgagctcctttgccctctaccttccagttgaatgctgccagtggaaggcactgataggagatcagatggtgggaggacagagactgggatatccctcgtcaccaggctgtgtgttggaagaggcatcattcttctactaaatccacagctcatggtgtgaggtcttctcctagagctacaggtgttagtgttttgctggtagttacttcctctggccctttcatgcctaggaatggaaatagctccctagtgctgccagccctggggtgcttcatcagctccctggtttcttatccttgcccacaccttgcaattagtcagtcttctcaatcactccgtttgagtatgccatctatttcctggcaggaccaggactgatacctactattttttttttttttttctggaaacggagtctcactctgtcacccaggctggagtgtagtggcacgatctcggctcactgcaacctgtgcctcccaggttcaagtgatgtttgtgtctcagcctcccaagtagctgggactacaggcacgcaccaccatgcccagataattttttgtatttttagtagagacagggttttaccatgttggccaggctggtctcgaactcctgacctcagatgattcgcccccactcggcctcccagagtgctgggattacaggtgtgagccaccgtgtccggcctcctgtttcttttctttctttctttatttttttttttttttttgagatggagtctcgccctgttacccaggctagagtgcagtggcgccatctcggctcactgcaaactctacctcccagattcaagcaattctcctgccttagcctccagagtagctgggattaaaggtgcttgccatcacatccggctaattttttatatttttgctagagacatggtttcatcatgttggccaggctggtcttgagccttctacttcttaatgattcttctaaaacatgatttttattggccatgtataatttcatcatgtagacttaaaaggatttctttaattccctattgttatatatacactttttatattgatttttatcacaatacatcaaagcatttattatgccattgaaaacttccaataaacacatttttaaaggactgttatattatggctggaccgtgaaccttgagttgtttatccagtagtgctaagagatttgttctgatccacctgatttcttttgtgcagtgtttatagtgactaaagaaacgtattttcaagatgattgggctggctatactctgtagctgccacagaagaaagcaaggctatgccccaatcccaccacattaagatccccagttcagggctcttcattaaaacagctaaacaaactggtgtaaacagtacttttacttgaatttaacatcttttatgttttctgggccagactttgtgtggatattggataataggcttggtggcccttttatatcccttgtgtacttgtaattctaggaaaaatacaaagcatttagtgggaaggatttgtaagagaatacagtttgatcaccatgtaacttgagtaaaaatagcaccataattgaaaacactaagagtagggttttaaggaaagagagtaagattggaacaaagtaaccatgaacttttcagttctgagctgcgagttctgttcattattcagtgaccctttgtgagatcttgtcttagtccattcacgctactataacaaaataccatagactgggtgacttgtaaacaacaaaaatttacttctcatggatctggaggctgggatatccaagatcaaggtgccagcagattcagtgtctggttggggcttccttcttggttcatagacagctgtcttcttgctgtgtcctcacatggtgcaaagggtgagggagctctctagggtctatttaataagcacattaagggaatgccttaatgcgcttattaaatgaagttttttgagaaaaaactcaaagtgctttctaaatttatctcactcaaccacaatcagtgcagacctgtgaccaaatgtaggtggtgtgaggggtgggtgggtgggtgggggaggagcatctccccaccaccaagcaagcaattagttttgtagcagataccaactggatatcctccaattcagttctgacactatctacttggagatagcatcagatcgttaccggaaaggggtcctgatccagaccctaagagagggttcttggaaataattcagggcaagtcggcggagtaaagtgaaagcaagcttattaggaaagtaaaggaatgaaagaatggctacttcagagatagagcagccccaagggctgctggttgcccactttttatggttatttcttgattatatgctaaacaaggggtggattattcatgcctcccttttttagaccatatagggtaacttcctgatgttgccatggcatttgtaaactgtcatggtgctggtgggagtgcagcaatgaggatgaccagaggtcactctcatcaccatcttggttttggtgggttttggctggcttcttgactgcagcctgttttatcagcaaggtctttatgacctgtatcttgtgctgacctcctgtctcatcctgtgacttagaatgtcttaactgtcggggaatgcagcccagtagttttgaggcttattttacccagctcctattcaagatggaatttttctagttgaaatgcctctgacaagatcccacagattgggggctcagtccccaaggttccctcttaagccctagaaatcagtagcaagtctcggcctctggaacttctgaccaactgactggcttcaagtgggggttcccatgacccctccttgaattcaattaattttctagggtagctcatagaacttggaaacttacatttaccagtttattataaaggatattaccaaggatgcagatttagagatgcatagtgcatgcagcttccatgctgtcctgggcgtaccaccctccagaagtctccaggtgcttagctatctggaagttctccaaaccctgtttatttatttctatttttatttttaattttttttaatggaggcttcattcagtagccatgattgattaatcattggccattggagatcagcttaacctttagcccccctcctttccctggaggttagcgggtggggctgaatatcttaaacctgttatcatgccttggtctttccagtgaccagcctccatcctgaagctaccacctgggggttgccaggcatcagtcaatcattagcatatgaaaagacatcacttcggagattctgaggattttaggagttctatgccagaaatctgtgatcaaagaccaaatatatatttgttggttttctttctttttgagacagagtcttgctgtgtcgcccaggctaaagtgtggtggcatgatcatggctcactgcagtttcaacctcctgggctcaaacaatcctcccacctcagcctcctgagtagctgggaccacaggcacacaccaccatgccaggctaatttttgtatttttttgtagagatgggattttgccatgttgcccaggtctgtctcgaactcctgagctcaagcagtcgcctgcctcagcctccgaaaattctgagatttcaggcgtgaaccactgcgcccagcccaaatatatatttgttaatatcacagacattcatcccattcatgaaggctcagccctcacaacctaatcaccttttaaaggacccacctccagatactctcacattgggcattggatttcaagataggaattttagagggacataaacattcagaccatagcagatctctttacttaggttaaccttgttttagtattacaaaaagcacttcagtgtgttcattcattgtattcaaaacatatttatcaagaaactactatgttcaaaacactaggatatggctgtgaacatctagaaaaattacccactctcataccattaacatttctcaagggagtcggataactaacaaataaacaagattattgtgaattgtgacaagtcctagaaggaaataaacaggatgatgaaagacagtaagtggggcaggacactttagactggatggtcagggataatacaaacctcattttatgtgttatggaaggtagtgtgtttgaatggagtgagagaaaactagaactgaagtccagctttatcaccttgtataagtttcttaaccttgctgaacaccatgacaggctgaaaatataacaagaacataatgataataatccctactacttatagtagtagcagaattaaaccagagaaaactcctggcattgtaagcatgactttctgccaggccccacataaatattaatttcctgttaactttcctaaaattacatataatctgaattctgtaatacccatttccaatgatataattttaagaaactgttctatacatcttcaaatcaatttaattcatcaaatatttattaagcacttactatgtgccagtctctggtgacctgatggtgaatagaataaacagtatccctgcctggtcagggtttaattattgttcttatttggctgagactcacaaagccatttctgtccactggttctcctgactagtagtaatgaatttttaccccactgctatgcacattttatgttaaacttttttttgttgtaaaataaaataaacatttaaaaaggttcataaaacataggccataaatcttaaaatctgatggaccctctcttacaaaaccctatatacttatttatgtgtcagtacaaacgtctaccattctgccactaaaaataacaaagaaaacagaaaaatagaagataattttttttttttttttttttttttttggttgagacggagttttgctttttcacccaggctggagtatggtggcacaatctcagctcactgtaacctcagccttcgggtttcaagtgattctcctgcctcagcctcccgagtagctgggattacaggcgcccgccaccacgtcagtctaatttttgtatttttagtagagacagagtttcgtcatgttggccaggctggtctcaaactcctgccctcatgatccacccgcctcagcctcccaaagtgctgggattacagggaagataaattttgttgttgttgttgacagagtctcactctgttgcccgggcgggaatacggttgcacaatcatggttcactgaagccttgaccttccaggctcaagcacttctctcaccttagccttctggctagctgggactacaggcatgcgtcaccacgcccagctattttttctattttttttgtagaggtagagtctgttgcccaggctggtcttgaactcctgggctcaagcagtcctcctgccttggcctcccaaagtcctggaattacaggtgtgagtgaccattcctggtagaagataaaatctgtgaccaccgtttggtgtctggacagccttgtctcttgggcctggaggggtaaagcagagtcagtcacgcaaagtcacataactggcagagactccttgaatttagaacagtttgtttaaccaagtggaagttgtttttttttctttttcttggcttattatttgcctatagcggcagtgcccatcttggggcagatccaggtttcacaaaacttaccagggagacctggccccatagctctggaaatacttcatatggaaaggataaaggatatctatgttaaaccaacatcaacatgataatgatgaaatgctaaaggcaaatataactcaagctaggaacaacttacagatatttgccatcaccaccatttaacataaacggcccacgatccttatttccaaatcttgagttttaagtcaagttaataagctgttaaaggaaatatgttctgtatgttctatatctccgccttgataactaaacctttcatgacttataaatcaaacatacaaatcaaaattgtaaagctatggtttccatatgactataagttaacaaaatataaaaaatgattgaatttaataattgttatacatgtctgggtgttctgatgatgtggtagcatttttagatgagtaataagataatgagttgtaatttattctataaaatttattttccttgctttcatttcagcaaaatcattaagtttattataatcaagatattcatatcaggcacatggcttatgcctgtaatctcagcactttaggaggctgaggcagaaggatcacttgagcccagaatgttcaggctacagtgagctgtgattgcaccactgcacttcagcctgggcgacagagcgagacccggtctcaaaaaaaaaaagaaaaaaagattaacttcatttttttctattcacagtaatgacctcaaatattttaaaaatgtaattgtattaaaatgtgcctaatttgaacatattttcataaaagtaaattatagcaattgcaaaaatgtgaaatattaaattatatttttcaaaaatgtcatttatcttctaagatatctcaacttgtctattgtaagatgaactaccaattataatttatgaatgtatttaatctgaacatttaaactttaatctattgaaaatcttataatttaatcttatattttcatgaaaataaaattattcttaattttagtgctaagtgatcatctagttatcaaggtaaagaattggtatcacacttggagcatgttatagctacatgtacagatgttcacatttaagagtaatgcgagttatttctctagaatcacaaattggaaaccaaagagaagcaagatgatagatgctcaacacttccagaaagatacttccttatgcaagaatcttttgcattcgtttagtctaagagaaaggatttgacaaggtaatttgtcaattctttcacctaagcattcctacttagatcctcccagtagttggaagcagggtctgtctccaaggccacggtaatacaacatttagaaacagtaattttttattttgagaactcagggccagacatacaaagaaacatttctcagggacctgagtggtattagcaagagaatggatatttagcattgtgggttgcatttgccagttctaagcgccacattcggagtgacagaggcacttacacatattccttagtaagttaatttttttatatttttgttcatggggaccttatacagtgtgagccccaagcagcagacctcttgcttagccaagggcatcctggccaggacttccagttatataaaccagtaaatgttttcatgcttaagctagtttaaactaaaaaaagagaaagaaaaaaatcctaaatcatacaagtaggtagaaaatataacagaaaataagataccattcatggtagaactctaaataaaaatatctagaattaaataaacataggtgataaatacaaatatgataaatataattaaataaacgaatgtggtaaatagattatgtgcagaatatatgggaagacaatttactagcccttgctgaaatacatgttagaaaagcagaaaacttgaataaatgggaaggggtgctatgttttagaagaaaagactccatgttataacaatatcaattcatttcaaattaactaatgcatttaagcaatttttttttttttttttggagacaagagtttcactctgtcacccaggctggagtgcagtggcaccttctcggttcactgaaacctctgcctcccgggttcaagcagttctctgcctcagcctcccgagtagctgggattacaggtgcccaccaccacgcctggcttattttttgtatttttagtagagacggggtttcaccatcttggccaggctgatcttgaactccttaagcaattctaattataatgaaaattgtgattgtctccccaacatccattctatgccaggtctatgggtgcccctgattaatccaagcaaataatctaaatcctttccttagtcgtgattgataagagaatgggcaggtgacaggattcagattaatgacacacaaaaaatggtttgctggtagcttttactcttctgccagatgtgaatgaggatgcaatgatccaggctgctcctggcagccattctatgcccatgaggagatctagctgcagggtgagcttgacacagtggatggcagagctggaagataggagatgaaaatacatgtgttattcagtggtattgagggccattgttttgggaaaccctgaaatttggttatcaatgccaacaaatctctattgtttaagcctcttggaattgagcttttggttatttaccgcctaaagcatagggatttttttaaaaagaaacaacaaaaatttagaatgaggaattaaaaatcctacagtgattttagcagtctaatttaatacagatattggccagttaggttaatgaaatagaatagaaagtctagatagataaatatgcatttatttggtgaacaatgctgagaacattgatagttatttggaaaaataataaattcatttcctcctacaaaaccaatcatatgcagattaaaggattaaactattaaagagctggaagaatatacagacaccaagtcttagagttagtgagggcctaataagctgaaagtcaaataaaatatgaaggtgtaggatcgtcttgaagtatttaaaacattatatgccaaggaatactataagcaaaaggtaaattgttaaaatacagttgaaatatatgtattataaatataatattaaatatttgaaatataaaacactgcaaaaaacatccaaatataaaaaaagttcaggtagctcacaagagaagaaaaaacattgatctgcaaatgcatgcgaaatgtttaatatccctagtagttaacaaaattgaatataaagagagaacttttttaaaccattaaattggcaaagattaaaaagaatgctagcacaacattgtgaatgactaaatgtcattgagtaattgttcgctttaaaatgttgaattttatgttacatatgaaattcacctcaacttttagaaaaacaagaggagaaaaaaagaatataatggagtagccagagtgggaagtatatagagaaatagcttctctcaggcactgcagtttgtattgtaaattggtatgtaaattttgcaagactaattaacagtatgtagatgaagccttgaaaatgtttatattctttcctttcttcctataattacacgtatagaaatatgtacctaggaaataatcagatattagatttatatataaatagcattttgttgttgttgttgttgttatcgttttcagagatggagtttcgctcttgttgcccaggctggagtacaatggcgtggtctcagctcactgcaacctctgcctcccaggttcaagtgattcttctgcctcagcctcccgagtagctgggattacaggtgcccgtcaccatgcctggctaatttttgtatttttagtagagacggggcttcaccatgttggccaggctggtctcaaattcctgacctcaggtgatccacctgcctcagcctccccaagtgttggcattacaggtgtgagccaccgtacccggccaatagtgttatttttaaactgtgaaaattataattcgtgttcagtcatagcatagtagttaaataaattacaatatactatatagtaaaatactgttcattaattaaaaaaaaattatgtaaccaagtaatctttttgagttactgcaccatggaaggaagaggacaaaggcacattgtccagctttaagtttcaaattagaattttttttttcatccataggaaaataatagtcttaaaagctagccttgcctctaatttccaagaattcttcacacgtcaggaagaaaatttggcagcctgaatgtgtacgtttactataagccaagacgtaagggcacatgcaatctggggcaggtagcttcccccttctgaaggacagaaggaaggaagaaaggcttttaggggagctgttacagagagcagcaggggttcagattgcagtgtgtctctcttgccctcccagagttacaaacctcagggatgtcattggcgtgatccatggtggcaggccttggggaacccaagaacccaggagtggtctgtacttccttggtgtagtccgcacatcttgggagtggcagggtagtgttgccggagggagatgtctacgtggatggcctgagactacgtccagggattcacagcttgtgtgtgtgatgcagaaccaggggctgcttgcgaaagggctgagtgaacaggtaacagaaagagatgtagggaaggataagaaggtcacagaccagagcaaatagcaaggtccagggacatacatcagggctgccatgtgcctatgaagtcttggcagaatcagccattgcacagcaggcagcactgcatggtgcctggtaagcactgggcacaaggggcttctcagtagaggctggtgaggatccagggagccacacccagagaagaggccttccactgctatcagcataagccaagctctcctttgcactcttctaggtctgagggtgtcctccagaattcatgtgttggaaactgaatccctagtgccagtgttgggaggtggggcctaatgggaggagtttaggtgggatcctcactgatggataatgccgctatgaaaagggtgtgtgggaatgggctctacgtttcttttcctcttctgccatgtgagaacacaacatttctacccactggagaacacagccttcaaggtgctgccttagaagcagagagaccgggcacaaacctgtcgtagccctgatcttggacttcgcagcctccagaactgtgagagaaattaaatttctcctctttataaattatccaatctcaggtattctgttatagcagcagaaaagagacacacccaggtgtcatcctgggggaaaaggagtgggaagggagctttttggaagggagaaaatacagttctaatagagagtgtgaaccttaaatgatagcatatttacttaaaacacactctttaaaacctttaaaaatatccaggaactaatacatggagaaaagaatttaggatacatacacagaaactcaataaagttaaatattttttccatatctcagttcgtataacttgatttccttgaaatcatattttttaaaatgtttaaggaaattagaagatgctcactattatattgttaaaagagcaagcagtagatataatattcgaactttctaaaatgatagtagttattaatattatacacacaaacacataaacacatttttaaacctttgacaaatacttctaaatattaacaaggattatttctgggtatagaattttttatgtagtacttttcgtattataagatgaacatacatttcttcttataatcagaaattgttgtttaaagaaacaaaccatacagccttgctactcacaagtatggtccatggccagcaaccatgggagcgtgttagaaatgtggattctcaggccccaccccagacctcccaaatcagtgtcttcattttaacaagatccccaggattgtgtgcttgccagcagcactggcgtaggcttcacactcccgttcccagcctactgatgtccatacctgacgctctgctttctcctgtttctgcagacaaacagcccctccgctcgtactctggatcctagcccacctgcctacccaaggactttctcctgcacctgtcacctctctcttctcctggatcattcccattggcaaacaaacatgctgtgatatctctttcacaattttttaaaccaaattttattttatatgtttaaaatacacaacatgatgttctaagatacatgtggatagtaaaatggttactatagtgaagcaaattaacatacccatcatctcacagttgaccattttgtgtgtgtgatcagagcagctataatctactcatttagcaaaaatcccaaatataacatgctattattaactgtagtcatgttgtccattaggtctctagacctgttcatcctaatatctactactttttgtcctctgatctacatttccctgtttcctccccctcaccctccacctaaccactgccttattctctaactttgtatatttgactttttaagatttcacatagtaagtgatatcatgtaaaaattttctgtgtctggattattttacttagcataatgtcctccaggttcatccatgttgtggcaaatggcaggacctcctcttttttaaaggccaaattacatattctatagtattctatagatcctatattctctctataattctattatatttaatatgtatatctgtgttttttttccatccttctgtcaacggacattcagattgtttctctatcttggctattgtgaataacgctgcaatgagcatgagagtgcagatatctttacaaggtggcaaattcatttcctctgggtgtatacccagaagagagattgctgggtcatatgacagtactacttttaacttatttagaagcctccctactgttttacataatggctgcaccaatcttcatccccaccaacagtgtacaagggttctcttttctccacatccttgccaatacttgttatctctttttaattatggccagcctaatgggtgtgagatggtatctcacagcagctttgacttgtgtttccccaatgattagtgatattgagcatcttttcgtatacctgttggacatttttacgttttgttttttgagaaatgtccatttaggtccctttgcctattttaaaaatcaagttatatgttttcttgctattgagttgtatgagttctttataaattttgaatattaatcctttatcagatacagggtttgcaaatacttttttccaatccataatttgccttttcattttgttgattgtttcctttgctgtgcagaagctttttagtgtgatgtagtcctatttatttatttttgcttttgtagcctgagcttttggtgtgatatccagtctcatcctttaaaacaaacaaaacaaaaccccaatccactttccagacctctgtcttcttcacatattgtcccatttttttcctgctcttcatgtctaggaaaacttgaaagacttgtctctcattgtctcccctttctctcctccctttctctctcactaatccaccgatactgctcttgttaaagtcactgatgacctccaagtgttaagtccagtggccaattatctgtcttcgtatctcacttttacctctcagcaacatcttttacctctctcttctccttggctgccaggatactctactgccatgatcttctgcctctcttactgacagcccgcccctcccagtctccttccatggttcctcctcatctcctgtttctggataggctggagtcccagcgtatagtgcttttctccctctacagttccatggctttcagtctcctctataaatggatataccccagatgtttatatctagacctgaactccagagtcacatgtcaagctgcttcacttgagtgtctaacaggcatattaaacttagtgtgttcaaaaccaaagtcttaattttctcccccaactcattccttacccagtactccctatatgagcaaatgcctatatgagcaaaagtccctttcttatagttgctcaagtcacaagcttggtataatccatgaattttgtttctttctcttccatctctcagccattactaaattctgttctacttgcaaaatatatctggaatctagatatcaatttctcatgcccccactccagtgatcccctcctcagcctgagtcatcatcactctcttctgagactattgcagtagctgtaagactcagctccctgctttcccctgtgcccccaacagtcttttctctgcacaacagccaccctaaccccctttcactcagaataaaacccaaagtccttgccatgcagcagttcaaggccccatgtaaactgccccctgctctccgccgtaccatcctctctctctgatctgatcttttatgcccatccaccttgctccctgtactccagccatgctggcctctccttgctatttcttgatcttggcaaacaaacacacaaatgctgcctcagggtggcacttgctcttcccgctgacatgcagtagaacatagtggtagtggttaagagcaagactctttggagccagactctctggggttcacttttcagctctgctcttcactagctgtgtgaccttgcacaagttaattaacctttctgagcctcagttttctcatctataaaatggggataataaatgtacctatatacagtccttaagagaatttaatgaatttatgagaagcagttggaatagtcactggcacaggagtaaatgctgtgtaactattaaccattattattactggaggtgtccatataaccctctcatttcattcagagctctgctcaaatgtccccttgttgaagatttgtttgaataccctccctccccctccattattctctgtcatcttaacctgcttcatttttcttcttagcatggatcaatatgtaagcatacgcttgttattagacagataataaacatatgtagacaggtttgcctattatctgtccacccacaggaatgtgggctccactgagaaaatgctcacagtcctggtgtatggcaggcacccaatacatatttattgagtgaatttctgaccagtaatgtttccttcttcagtaattgataaatgtaattaatgacataaaatcttaaatctctcaaaaatcttgtttctacttaaggactcccaaatttaaatccaagaactaatacatggagaaaaaaatttaggatacatacacagaagacgtgtatatatgtgtgtatatacatacacacatatcagtgtacggaagccagctattctttcttgggaaatatttttttctcctgtatctgaaagtatgtccttctttttatagtgttagaatattctttctttaattaaatgctctagatagtagaagagagttttaaaattttccctagtatccctatatttattactgttttaaaatgtccctattacacagtacttatttttaatttttttaaatttcacatataaaatgttgtcaaccttatggtgcttttcaaaattaaaaattactagtctgtgaaatccgaaagtctgagcactgtttaaaatacaaatgaagataacatatccagttttattgatataagtttctaattccagccagaacctgggaagttgtgtcattagtcaaaaaactttgatgccactttgttcattatatcttacctgttatatttaaaaaaagaggcttgtaatattttttaaatagaagatgaaatatgggctttgtattagtctgttctcacactgctataaagaactgcccgagattgggtaatttataaagagaagaggttttattgactcacggttctgcatggctagggaggcctgaggaaacttacaatcatggtggaaggcaccccttcacagggcagcaggagagagaatgagtaccagcaggggaaatgccagacacttataaaaccatcagatctcctgagaactcactatctggagaacagcatgggggaaactacccccatgattcagttacctccacctggtcctacccttgacgtggggattattacaattcaagatgagatttgggtagagacacagagccaaaccatatcaggcttcaattagtagtccctatgaaaatattgcaaatgtgacttaaacatgaaaacaaaattgagcaaaacctttcacataatgctacacttggttcaagttgaagtcctggtttaaattgttttaagacttattgaagtgttaactgtccttttaaagaggaaaagagacctccattccctgtttgtcaagtaccgtactttttagttttattttgttctaataacagaagaagaagtggtaacatttgctgaatacttatgtatctgttaccacattaatatctttattatctcatttaattcttaaaacaagtctataaaatggaaatgatgatcaaacttcgttgatagaaggaaatgtaagtttagggagagtgaaataactcatttaaacagataccacttgttagatggtagtgctgggatgagctcccagagctgactctaccctccatctgaatcaggtgtgtatttcttgaattggcacacacttagtcgtgacaagtactcaaaagataaaataaaaattgtattgaatgaatacaatttagctttatatttgtttttttctttcagttgtattcttgttttgctcataaggccaaattttcatttaataatatgtgaatttatactcatgatgaaaatcaatcttatatttttaatctataatataggtgggaatgtagcctggaatgactgacagctgttattatacaaatagcacatgctggcaaaatggcagcaatttttgtgatctgtaattaggatattactgttgtctttatatctgcaaataagtagtaatgtattagaaagtaattggcataatgagttgggaaaaaatagaaacactctcatttatgattcatttaaaacttgcttaaacattatagagtaaaatattctgttcatgtgattttatttgtgctgtgcttaaaatattaaaaatcagatttccaaataggcatgatatatgaagccttaggactgatcatctttcaccccatcaacattttcttttttttctttttgagatggagtctccctctgtcacccaggctggagtgcaatggcacgatctaggctcactgcaacctctgtctcccaggttcaagtgatttctcctgcctcagcctcccaagtagctggtaccacaggggtgtgccaccgcacctggctaatttttgcatttttagtagagatggggtttcaccatgttggccaggctgatcttgaactcctgacctcaagtgatccacctgccttgggctcctaaagtgctgggattacaggcatgagccaccgcgcccagcccccatcaacattttcttttgggaacactgtgtaatggattttagtcaattctacaggaagtaaaacatcaatatttggaagtgaaaaaaattaactgcatacttttattgagttaaagctttcctttaactcagctttttcatccaggaggcacgttattaaaatcttgagtgcactcattgattatttttcttttatcaggaagtccataatgttatataataatatattatatgaacatatagtacaaattatatctattgagtaataagtaccatcaacatcaaagactatgttatttttcacctttaattttgttctttttttctctttaatatatttacaagttctgcaaacactttctgttgctttgtcatgttattatcaatttgtttgcaagtgtcatgtttggtattcctaactagatatgaaagctatttaggttaggaatgaactgtttccttcttttatgaacctttataccttcttacaatgctatccacatagtaggctgtcacttgactgtatattactagaagtgtatatattcagagttggtatcactagtggaaactctagaagctattttaggatgttgtgttttctgataatgaatattcaaatgaaggtaggaatagagagaaccatatgcattgacttatttttggtacctccccaaactaggtcagaatagagacctcaaaattcagtggctaaactgcttcactcttttctttttagtcatatttacaatggcagtttttgatcttcacagaacttcatgtgcatctgcctacagggtgtttctcttctgttggcctcattagctcctttgggaatgtggtcactgctataaaagggccgattgttagattctatggtatagagggcattgccagtcacaaaccaatttacctagcttcatggacctccgcagatcttctcagatccttaaacttctttgttgctagtgataattaactgagagatgatattaatattttagatatatatcctttgacagtcagcttcctttcacgactatagttaatagatttaatcccttaagtaagtgtcactggaagcccaagtaatactagctgaaacaaaagagagggtggtttttctcttacgtaagagaagtacagagatacacagttcatggctcgcatggcagttccctgcttacaaggatcccaaactccatcctccagggcacctcatggttgccatgtggcccccgcagccccagctatcacatccgcagccacgttgcaagaatgaagactggccaaaggcaaaaaaaaaaaaacaaaacactgtactaactgggtcaattgtctttaaagctttttcttaggagctgttattcagtgacatgtgcttcatttagttgcaagagaggatggttaaataattttttagaggggtacattgtcatcgttttgttgtgggtttttttttttttttttttttgagacagagttttgttccatcgcctaggctagagtgcaatggcgcgatcttggctcactgcaatttctgcctcctgggttccagcagttcttctgcctcagcctcctgagtagctgggattacaagcgcctgccaccacactcagctaatttttgtatttttagtagagacaaggtttcaacatgttggtcaggctggtctcaaactcctgacctcagatgatctacccaccttggcctcccaaagtgctgggattacgggcatgagccaccatgcccggcccacattgtcatcttaattaaaattggattttattactaaagagaaagggctgaatgtgtattaaatgggcatctagaacttctgccataccttgatatttaacatattttattttttcagacagggcctcactctgtcagccaggctcaagggcagtagcacaatcttggctcactgaaacctccgctcactgcaatctccacctcccaggctcaagccatcctcccacctcagcttcccgagtaactgggactacagacttaacctattttaagatttgtcctttaaaaaaaagatttgtcctttttcccaaatgagccatggatgtgtgctttatatggctttgtttctgtggtaaacatacacagacctccagccaagatttaattttcttcttctgatgtgattatttcaattttttttaagatttggtgaattacattaaataaatatttattaagctcctctcatcatcaggatactgtgctagatagggattctcagctttggtgctattggcatttggggctggataattctttgttgtgaggggctgtcctgtgcattaggatgtttagcagcttctctggccttcaccctctagttgcaactagcaacccccagtcgtggtcaccaaatttgtctccatatattggtcacatccccagtggggatgaaatcgcccccagaggaccatggtgctagaagatagccccacatttatgtgaattgcctgtttgatttcctgtgaaagtgtatcatggtagattaagtgttgcttgaactgttgcttgctgttggtattacgagcgaagtagtactggtggaattttcatgtgtgctggacaccatgatgagaactgtccacgtgtcacctcatttaatcctcatagcacaacactgagttaaaacagcactgtgttaggagaaggtactaacaagattaggtagtattataacccccctttacagaggagcaaaatgaggcttagagattattttagctgagatctccctgagagcaagcctgagacagtgagtggttcgttgggaggtgatttcaggaagcagaatgatggagaggggagaatgaaacagggaaggaagaaaagctaatacaggagttgatgttgggttgagagctacctcaggggtcacccagggcactgtatatctgaggactctgaggaacagtgaacaatgcatctcagaattagttctctctcccactccctacaggggttgcgggggaggaagctggaacttctccacgtactcccatcttccccaggggcatgaaccccctttccctttacctataagagtagtgagcagtatacacaaagatccagcttttgaggagcttatagtcttgaggagaaagcaatacattagtaagcaacatagtatccaaaaccaatgcatgctctgagaagacagaacgaaggttgtgtgacaggagtgcttggggaactccttagatggggtggccaggatgagggatgagctgagaccccaatggcaaggagaagccagtcatacaaagatctagggtaaaggcattctaggcagaggaactgcatggtgcaaaggccccgaggcaggaacacattttctttgaggaataagtagaaggctagtggggtggaaggctgagaggaaggggatgtgtggtggaggatttggtcaaaagactggggagggacagtcaggtcttgggtaagaaacatattttattgtgcgtacttcttcctacactggagggttttaagcagggttcaagtgatctgcttaggattttattttattttattttattattttattttatttatgtatgtattatattgtattgtattgtattgtattgtattgtattgtattgtattgtattgtattgtattgtattgtattgtattgtattgtattgtattgtattttaagacagtttcacttttgtcacccaggctggagtgcagtggcacgatcttggctcactgcaaccttgggctcccgggttcaagtgattctcctgccttagcctcccaagtatctgggattacaggcctgcgccactgcacatggctaattttttatttttacagcatggtttcaccatgttggccaggttggtctcaaactcctgacctcaggtgatccacctgcctcggcctcccaaagtgctgggattacacgtgtgtgtgccactgcgcctgggcaacttatgattttaaaaagaacactctggctgctgtggagaaaggagtgtggcaggggaagagaggaagccaggaaccagttaggaaggaggctatcatatggttcccacagggccagctacatagtttgtggggcctccagcaaaatgaaaatgtgggggctcttgttcaaaaagcagggggaagagagtactattaaaggtactaaactataaaactttttgtttcacagtccatcaacttgtcatggtgtgtttttgtttgttttgttgtttaatgtcattctaagtaaagaaaaattaaagcttaaaatattagtatgaattttaccattcatctgtatattgtgcaatgctggttttaaatgcaaatataagacatttttagggataaaagacttataaaaaatgaacaaaaaccaataaatcaaagaaaacatttagctcatatccagaatcactgatattaccgaacttacatttcatagttcatacatgcatatgtactttgttcttaccagaactgtggaaatgtggcacaaaacaagctcaactgttttatttcacttctcgttccgtgcccattctaccaacactctctcccctcagcttcctggtagataaaagatgggcaaggaaaaggagctctgggttgccctatgattccctttccttctctcgtcattttcagcatgggtgctaggttaacacagggaagtaacacaaataagagaggatattatagggtttcttggtcatttaggtttctcagaacaccattgccttttttctgtgctcacagtcaattctggttcaaaaggcaagcatggcccatcagccctgtgaacggtccttgctcgctgagttgtagatgtaacactcttacttcatacttgcttctaggctcactaagctcccatgcattgtggtaagctaaaattctgtgctcatgggacatcgtgaacaccatacccacatggggtcttgaggaaccacagacacacatggcacctgtctcctctgctcgtgcacacgtgtcattgtcccatcagatttcacttgcccaagatcaaagattattaagattttcaggatggtgacagcagagcatcagactaagtctgggacctaagtgaggggccctgaaccactgcacaggctacacacccatgaggcctagatcctggtgagagaagacaggatagagacttggctggtacaagtggagaaaaacaaagtgttgagtaagttttggggttagatggtattaccaagacttgttgtggattggatctgcttttggatagggacagaagagaaatcgaggatgacttacttctaggcttattacttaggaagatggaaaagactataggagaaataatttttgaagtgagggaaatacagagttgtgaagtttggatttaccttggtttaagaactatggagctgcagagccaggatttcaacccaggcagcctgacttcagagtcagtgcctttaaccactgcactgcactgttctgtcatgcgggacccacgctgatgggtgcctggtgatcgttgcaatggttctgtatcttactattctctgccctctctggacgatccaccaactgtgtgcagtgagcatccatgcagaggcatgcttgaatttaaacacagttttgtattgaaacctagttaacaaatattcctttaactcacaagcttctcttttgcatctcaattatatttgtttttatagaaaggatatctttatacagctttgctcattcacatgaaaaggaaagtgtgttttcagttggaagatgtggagtcaaaaaatctgaagctgagtttggtatctctcaattgctagctgtgtgtccttgggctaattaattgctttgatctttggtttcttcatctataaagtacagatggttttgtgtgggtgtatgtgtttatatgtgtgtgtacatatatacatgtgcatatatctatatatatgcacatacttgccctcatcatatacaaggctactgtgaagattaaatgagattatagaggaaatccaactcaacaaggcttgagttggatacccattggcagtcactccctatttccctctaccctcaaaccctggcaaccactaatctactgtctgtctccatggatttgcctattatggacatttcatataaatggtatcatgcaatatatgccctttggtgtctggcttctttcactgaggataatgttttcaaggtttattcatgtagtagcatgtatcagtgatacattatattttatggccgaataacatgaatatgccacattttgttgatccattcatcagttgatggatatttgggctctttccactttttggctattacaaataatgctgctatgaacattcatgaacatacttttgtgtgtacatatgttatttgttctcttgagtgtattcctaggagtagaattgctgggttatttggcaactctatgttaactttttgaggaactgccaggctgttttccaaaagtgtctgtttcattttgcattcccactggcagtgtatgagtgttctaatttctctacatcctcaccaacacttgttattttgtcttttttattataactattctagagtggtaagtggtatctcattatggttttgatttgtatttccctggcggctgatcatgttaaaatcctttcatgtgcttatcagccatttgtatacactctttagggaaatgtctatccagattctttgcccattaaaaaatttgggttctctctctctttttttttttttttgagacagagtctcgctctgtcgcccaggctggagtgcagaggcgcaatctcggctcactgcaagctccgcctcctgggttcacgccattctcctgcctcagcttcccgagtagcagggaccataggcgcccgccaccacgcccgactaattttttgtatttttagtagagatggggtttcaccatgttagccaggatggtctcaatctcctgacctcgtgatccacctaccttggcctcccaaagtgctgagattacaggcgtgagccaccacgcctggctggttctctttgttttaattgtcgaatagtaagagttctttatatattttgaatactagaaccttatcagatatagaatttgcaaatattttctcccattctgtaggctgttttttcactttcttggtcttgtctttcgaagcacaaaagttttaaaattggatgatagccagcttctttttctttctttctctttctttctttctttctttctttctttgtttctttctttctctttctttctttctttctttctttctttctttctttctttctttctctctctctctctctcttttttcttttcttttctttcttctttttttgagacagtcttactctgtcacccaggctggagtacagtggcacagtctcagtcaccgcaacctccaccttccaggttcaagcaattctcctgcctcatcctcccaagtagcttggattacaggtgtgcgcccccacgcctggctaattttgtatttttagtagagacagggtttctccatgttggtcaagctggtcttaaactcctgacctgaggtgatccgcttgcctcgacctcccaaagtgctgggattacaggcatgagccactgtgcctggcccacttatttttcttctaagtttctgcttaaagccctgacgtttaggtattcgattcatcttgagttaacttttgcatacagtgtaaggtagaggtccaatttcattgttttgcgattggctatccagttgttccagtcacccaggctggtgcagatcgtgcagtggcacgatctcagctcactctccgcctcccaggttcaagcagttctcctgccttggcatcccaagtagctgggactacaggtgcgtgtcaccatgaccggctaatttttgtattttcagtagagacggagtttcaccatgctggccaggctggtcaaactcctgatctcaggtgatctacctgcctcggcctcccaaagtgctgggattacaggcatgagccactgtgcctggcttttttttttttttttttctgagatggaatcttgctctgtctcccagtctggagtgcaatggctcgatctcacctcgctgcaacctctgcctcccgggttcaagcaattctcctgccttagcctcccaagtagctgggattactggtgcccaccaatacgcctggctaatttttgtattttaagtagagacagggttttgccatgttggccgggttggtttcgaactcctgacctcaggtgatccatctgcctcagtctcccaaagtgctgggattacaggtgtgagccacggcgcctggctttttttttttttttttttttttttttttttttttttttttgagatgagtcttgctatgttgcccacgctggccttgaacttttgggctcaagtgatccttccaaggagctaggattacaggtgaacaccactgtgcctggctcagacagtcttgattactgtagttttatagtaagttttcaaattgaaaagagtgagtcctccaactttagacttctttttagattgttacggctattcgtgttgccttgcaaatccatatgaattttaggatcagcttgtttatttctgcaaaaaaggctgttggaattttgataggtattttattgacactatagatcaactttgggagtattgctatcttaacagtattaagtcttccacttcataagcttgggattgtctttttatttatttagatctttttaaatttcttccaacaatgttttgtagtttcagtttatagtcttgcacttcttttgttaaatttattcctaaatatttattcttcttgaagatactgtaaatggaattatttgcttaattttattttaagattgtttattgataatgtataggaaaacaatttatttttgtatttgatcctgcaccctgcatacttgttgaacctgtttactacttctaacaggtttttggtggagtcctcagaatcatctatatataagatcatgtcatatgcaaatagagatagttttacttcttcctttctaatatgaatgacttttatttctttttcttgcctaattgctctggctagagttccagtaattgatgaatagaagtggcaagagtagacattcttgtcttgttattgattgtaggggaaaaataatttgttcttttataatcatgttagctgtgggtttcttgtagatgccctttctcaagtggagaaagcttctattactaaattgttgagtggtttttctcatgaaagggtgctagattttgttaagtgctttttctgcatctgttaaattggccagttggtttgtttttcctttttctactaatatggtatattaccttgattgcttatcatatgtcaaaactggaatactcttctaatacccccttttttttttcaaaaaggataagtggtgatttactttctgaatgcttataaatataaaatttcttccaatcaccttatagattatattaagcttgtccaacccacggcccaggatagttttgaatgcagtccagcacaaattcacaaattcataaactgtcttaaaacattatgaggtttttgttgttgttgttgttattgttgtttttaagacggagtctcgctctgtcaccccggctggagtgcagtggcacgatctcggctcactgcgacctctgcctcccacgttgaagtgattcacctgtctcagcctcctgagtagctgggactacaggcatgtgccaccatgcccagctaaattttttttgtatttttagtagagacggaatttcaccatattggccaggctggtctcgaactcctgacctcatgttccgcccacctcggccaaagtgctgggattactggcatgagccactgcgcccggccatgggatttttttttttttatgattttttttttcagctcatcagctgtcagtaatattagtgtattttatgtgtggcccaacgcaatttttcttcttccagtgtggcccagggaagccaaaagattggacacccctggattatatcttgcctggacacaagattcttggaatgcagtccttttttcttaaaagtttatatacttattctaggttccagtgtggcatatgaaaggtccgatgccagttgtcattattttgcttttataagtaaatatcctgttcttgctgtcttgaagcctaaaagacttgttctttctagttggagtttaaaacttcaccataaaaatgtgaagaatgtgtcttttatttcccttataactgcctggcattcggtgagctcctttgatctaaaaaactcaattctttcttcacttcagggttttcctatttgattattgcttctgctcttttctctcttgctggaaatgctatttgcttattaggcctcctgaatctgtcctgtatgcctgttatattttcaccactgattgacatttcattatttctgctttgtgatgtgatagttcctttgcttcatattccagtttactagtttggtttttaataccagccattcattttacatccttttggaacttaagccccagagttcatgtttctcataggcaccttctccttgagttttcgtagttattctccttgtgtatccccttaaacattcttattacatttttattgtttcttccattaatttggcttttgtaaaagttgcctatctctccattctggtttccctcctttgaattgctaagtcccttaaatgtctacaaagtttctttgctttgttaggtcagggagtatgtattctcaagcacctgcataggcatggtgggtaaagtctgtgaggccatggtggatattgccagtaacccatgggagctggtctaaaaaattctgagacagcatctgggcctagagagggaaccaccagaaaaagcagtcagcatctgagatgatgcccggagagaagcagatagaccatctgcaaggaagagaaggcttggtttcttagagggtgacctactgttttctgttcttgtccttggtttctcacaaaacctttgcatatcctcttatgacatcagtatacattctcctctccccgcctactcctattatacatctacccttcacctctttgagatggcttgagttgatctgtcttcccagatgaggcagcagtcacatcctgttgctgtgaggtattttcagctcttccacaaagggcctagatggtaaagacccatctcttcaaaattctttctatagtgacttagatttaccttcccaagtatctcctttttaccaatgtcttccaaatattttcattcctttataaatcccttttctgaaatactcctcccctctacccctctgaagttcaactttcttctcagagcctttagtctacacagatttaccagagtgtttgcataattgggtcaggatattcatctgcagctaattttgcacttttaatgtgatacaagctttggtttagggttaatttgtatcaataattatgaataatgtacttatcaaacataaattccttttttgagtgtatatatttcctggatatttatggccatgttctctttaataattcctatatttatcattctaatttacttctattgcctagtccaaggatcattctgcctagtactgattctgcctagtactgatgcattcttttgagaaggaataaagttactgcattattttaatgtaagcttgctttttgatggggcatgcacactgcctcctcaccctcttatacctgaaactttccatatttttgttaattcccctgtccttgaagacatttggattttaagtttggggccttgggctcagtatatcgttgtaatttatttgtttgcaaataattttcttaaatattcataatgaatgacattgtgcattagaggcagataccatgaattgtaatttagatctgttatttaccaccattgctggtcgtgcttggaaaactactttgaattattctcctatccacttaaaatttattttcaagtcctgtgattctaaaatgcttttattcagattatgttatcatatgttcttgtttaattaggttgcctgtcactttgctaaaggtctaattagaaacgatatctctattgtgtttgattcagaatgaatgtactaaaaggcactttgaaaataagataatgtcctcgatgatgatatcctttatttatgccaggtgcctattagtattttgtaaactctccatttcactttagctcaatctaatcctctttgtgatttttttccataattgtagagtaaataaaattcacctactggctccaaaatgtaatttagaaatgcaaactaaatgttcccctgtagggggtgcaatctgttttaaactctcaatatgtgtaatgaaagctataaaccatagagggaactttcgtgggttccatccatattgttcggggcaggctttttgagtgatttgaaaactttgtaaatttgatggtagccaatgtttttctcaagttataaaatttacataatattaggatgaatgcagtacatttatttttttgttatgatttggggcattgtattagagttctctagagaagcagaaccaattgtgtgtgtgtgtatatgtgtgcatgtacatgtatatatatgtatatatgtagagggaaagtatgtgtctgtatatatgtttatatagatatctatatatagatatataggtatatatatgcctatatctcaagttattatatgtacatatatacaacatgtatatgtgtgtgtgtgtgtgtgtgtgtgtgtgtgtgtataaagagaatgtgaggaaatggctcatgcaattatgatggtgggcaagttggaatttgtagggaaggctggcaggctagaaattcaagtaagagttgatattgtagtcttgattctgaagcctggaaatggttagaacttctatgttgtagtctggaggcagaatttcctctctcagaagcctcagtctttgttctttaagttcttcaattggttgggtgacacccacccacattatggagggtaatttgctttacttaaattcaactgattgtaaatgttaatcatatctacaaaatacttttacagcaacttctagactaaaatttgaccaaacaattaagcaccatagtctagccaagttgacacataaaatgtaacatcacaggcctcttgcatatgttattgtcagtaagccaaattaaagataatggtagctagcatttttactaacttggattcaatatttagtgcaactctgcagtaataaagatgtgaattatactgtagcactccaaaattgagtgaataggacatgaaacaaaagccatgaaccatgattcttatcagtttggattttttccagaacattttttgagtcggtcttctgcaatggtattgttctagtttgttctttgaaactcagctttcaagttctgtgtgtgcattcaatattgggcaattttgaacgcatacttagaagagcggccaaaatgtagattagagagagaaggtcaaacaacttctcatcctgtgcaatttctgcaatcctaagcctgttataacacagagtgttccaggacctcccacagatccatgaaatgtattctctgggttatggtctgcatgtgatttgctgttccttgatgtcaagcttgctgttcatctgaccctcaagatccagtcagagtcttcagtcacactcaccctctaatttttttgtatgtgtgtcaccaagtttttgtcttctgtaattcagttcacactaaaaaaaaaaaaactttttatttcccccctatatccctaaagtggttcttcctctttccctcccctcttcttccctctgtctctctgatttctcagtttgatcctgatgtgaataacatactacccttagtcttacatttctaatttttactttctgtgggaaacttccatctatgtttttcttttttcttttttaaatccttagcatagtaaatggaggtttgttgtgtgggtgtgggagccgggggtgcagggggtgggatgtttctttttaattgttagagcttgatctctacatgactttccattagcttggaatcatgtgactcccagggttgggcaggaaattagcttttgtccagaagagcaggatacaacaaaaattattttcttagctccaaaggcctctttgctgcagaagcccaaattgaaagagtggcttagtgattcacttaagtcattagacagcctgctgataagaattagtttagattttgaaaaaaaagggagacttttttttttcagggctaagtataggtctcagttatagagaaaagtaagaggaaaaattgtcatatgcatacagtattacataatattctatgtcataaatcaaattttatgggagtaggcatttgttgcattgtgtcctcatacccaattgtgtgattgtgtgtgtgtgtgcatatatgttcattgaggcaatttgtaatagaaagtttattggattttactttgatttctcctttattaaagtattgaggaaatgacaaaaacaattctttgcttttactttttttttttggcaagctccacttttaaaactgtttatttttacagatgtatttcatcagttcttaagaatgaagctaggaatgtttgctggcttctcagttagtaccacccagaaactgaaaaaaatctgttttcttaaaatatgacattggggggaagtagagaaacttttcatttttgtgacctattggatttaaaaaaatatatttaaataatgcatttttaatattgctgtttaatgtactgcttatcttaattccatattgctttctgactcttggttgttgtacttattattttatagttaataattgtaatggaagggggataaaagttcatgttttattttctctggaaaatttgaataccctgtccatcctagaattgtttcttattcagagagcctcctccaggtaagtctccaagaattttgacacttaataatcaagtgtgactctctgatcagtcaacaagtacacttcttataaggtatgtcttaaaataacaatattaagacattgtttggactcattttctttggaccagactagaataagctgagtgagaaaatgacctggaatggttcattccttcatttcgcaaacatttattacgcttctcagttgtaacaggtgttggcaccgtcctatctcttcagaaactgacagttcagtttgagacaaaaaatgaaagcatttacaattcagtatagagactgttaaaaaaggggttccttttcctgattgcatcccaccatttctggccatcttcactctattcctgccatgttgagctttgaagttgaggaataaagcagaagcaaggatggaaaaaaacttactttgcaatcaataaataaaatttaaatcaaggccggcgcagtggctcacacctgtaatcccagcactgtgggaggctgaggctggcggatcgcttgaggccaggagttcaagaccagcctggccaacatggcgaaaccccgtctctactaaaaatacaaaaattagctgggcatggtggcgggcacttgtaatcccagatattccggaggctgaggcaggagaattgcttgaacctgggaggcaaaggttgcagtgagctgagattgcgcccctgtactccagcctgggtgacaagaatgagactgtgtctcaaaaaaaaaaaaaaaaaaaaaaaaaaattaacagagaaccatggtactacattccttttctcttaaatccttgataaaactaatgtatatcataaagcagagttccccaagttgagaaatagatcccatcctcttttagaaaaataaaatccctggacttccaatgttgactgaaattgcttttattatgttacttacattacttatattgtttattacattacttaatatatacaaacatataatttttgtgcttataactctatacaaataaaactaaaacaataaatataaatagaattacaaaaccattacattcaaatgagcggtgttataattcacttccaatatgttttagtgggatgggtgactctgctttgttgaaatagttgttgatttaggggattatagtagaaagatgttgccacaagtctagttctatggttcatctgtttctgtatttgaattttgataatacatatctaacaaatacctatttgcacaagtattgtaagtacttatgagtattgtttattcaaaacagtattaataattttcagtctctaattggaaattaggctcattaagtctttttttttcagtaaaactctgccagtgaatagtcttggaatagcagattaaagatgtatcacttggtaactctttaaagctccattacttgagagtaaagttagcctgattgacatcttcattaaataggcatctgatgcaattgctgctaggcccaggaatagaaaaaaaatttttttgcatacttatgaccatacttatttccaataaattgatatgagttggtataagcaaagatggcactggtctctttcacctctctgcttatttggaccatagggccttccttctggccgtacagatttccctgaagtcaactgatgtaaactcaattgtacatacaaacgactgcacaaagatctcatgaagtactcagttgcatggggtcatctgaaagacgcagactatctttaaatttctttttatagattatcataaaaattaaaacagaaatattttttaaaacatcaataatttgaagacctttaataatagattcataaatttttgttttagaaatactgttagagtttcctgatggcaaaaaatgaataaatactttgggctccaaaaccaaatttctatgcatttaaacatgcaaatagtttttcaattctaaagccacttaaagtatagcattacagtgatatttaactaatatgaaatatgcattttatgtaagtttgatgtgtgttttattttaagagaaaaacctaactgctgttagttcttgctctgctaatcccatctacttggtatcctgatctacctagtttggtttaaagtatgattgggaagctcagctttggtgtcttttatatccagtcctggctatggttagtgttgtcagttctatgtttgagcatataatttttattttattttactttggaaactatgatgttcaaatcttcatgtattactggttatatttaatttgaatatttcaatattagaagaagtgatttgtttaccaaactctagactcaccagtgtttcaaatatctaaatgatgtctaccatttctttgtctatgtattgcattacagtgcaactttaaggctcattatttcatctttaattgaccagcagggtaagacataatcagtgcttgaaagtgcaaatagagcaaacttgtatgcttcatgatgccaggaactctgctttctttctgtctctctctctctctctttttttctgacttatttctagctaatttatttcgggcaggatttcaaccaggggctgattgtaagctccactcactgcctgccatagtgcttggcacatagtaggtgttcactgtagatgaatgaagggataaacaaatgaagaatgaatgactggtatactagtagtggtgatggcgtggcagtgttagttttttagcagaggcaaattttggattttttttaaaaatctgaagctggagagttttatctcactgatcttcatattgcccaagcttttatttattttgggggatgcaaagtcttttagaaaatttgctaatttcattgactaatacacacagggtgaggatgatctttggaaaatcaagtggatggattgcctttcacattgtagtaaataattgtcatagattacatatcaaattgcacatagaatttctgcttttcaattttaatttgagttcacctgtcatcctgggacctcagctgtaatctccttttccctgcacggctgactgagaatgcatttccttgtgctttactaggactggaaaaacccagttatgatcatcttagtagtggtctgtcttccaggctttattatctgcttcccaactctcagcatcaaaacaggagttaccatatccaatgaatacaaagaaaatggcttaatttctgacacatagcttattgaatgtgacccaggcagcaaggatgtggtacagaggagctaatatgcattcctcattagtcagctcacccatgtggtcagcagattccttttctaaagtagttgtgtaatctgcagcagcacagtagccaaacacagttgataaattacgtttatttcattttgacaaaaagagtaaatatattcttgtacaaaaatattcaaaaagtttaatgtaaagaagtaaatttaaatcacctgtaatctcaccatctagaaatacactcatttaaatagaagctgccactttactttttttttttttttaaatgtcatggctgttttttctccaacttttattttaggttcaggggatacatgtgcagatttgttacatgggtaaattgcatgtcacagttgtttggtgtacacattatttcattactcaactaatgagcctagtacctgatagtttttcgatggtcaccctcctcccaccctccaccctcaagtggtcgctagtgtctgttgttcccttctttgtgtccatgtgtacccagtgtttagctcccatttttaagagagaacattggtatttggttttctgtttctgcattaattcgcttagcataatggcctccagttctatccatgttgctgcaaaggacatgatttcactcttttttgtggctgtgtagtattccatggtgtatatgtaccacattttctttatccattccaccattaatgggcatctagatggattccatgtctttgctcttatgaatagtactgtgataaacatatacgtgcacgtgtctttatggtagaatgatttatattcctttgggtatagacccagtaatgagatttctgggtcaaatagcagttctgttttaagttctttgagaaatctccaaactgctttctaatttattcccaccagcagtgtataagcattcccttttctctgcaacctcgccagcatctgttattttttgactttttaatagtagccattctgactggtatgaggtggtatctcattgtggttttgatatgcatttctctaatgattagtgatgttgagcattttttcatgtgctgttggctctgtgtatgcgttcatttgagaactatctgttgatgtcctttgccccccaccccacaccccctacttttttttgagacaggatatcactctattgcccaggcaggctggagtgcagtggcatgaacgctgctcactatagcctcaacctcccgggcccaagcgatcctcctgcctcagcctcccaagtagctaagaccacaggggcatgccaccacacctggttatttttttatttttatttttttgtagcgacaagatctccctggtcttgaactcctggactcaagcagttctaccacctcagcctcctgaagtgctgggattacaggcatgagcgcccatgcctagccatctttgcccatttttttaatggggttgtttggtttttgcttgttaattcgtttaagttccttatagattctggatattcgagctttgttggatgcataatttgcaaatattttcttccattccataggttgtctgtttactctgctgatagtttattttgctgtgcagaagctccttaatttaattaggtcctacttgtcaatttttgtttttgttgcaattgcttttggagtctttgtcatgaaatctttgccagggcctacgtctagaatctcatttcccaggttttcttctagggtttttatagttatacatttcacgtttaagtctttaatccatcttgtgttgcttttttatatggtgaaaggaaggagtccagtttcaatcttctgcatatggctagccagttatctcagcaccacttatcgaatagggagtccttttcccattgcttgttattgtcaactttgtcaaagatcagatggctgaacatgtgtggctttatttctgggttctctaatctgtttcattggtctatgtgtctgtttttgtaccagtatagcacacttttggttactgtagccttgtagtgtagcttgaagtcaggcagtgtgatgtctctggatttgctttttctgtttttgttttctgcttaggattgctttggctattcaaacattttggttccatatgaattttagaagagttttttctaattctgtgaaaaatgtcattggtagtttgataggaatggcatcaaatctgcaaattgcttaggacagtatggccatcttaacaatattgattcttcctatctgtgagcatggaatgtttttccatttgtttgtatcatatctgatgtttttcagcagtgttttgtaattcttgttgtagagatctttcaccttcctagttagctatattactaggtattttattctttttgtggctactatgaatagaactgcaattttggtttggctctcagcttggatgttactgacacatagaaatgctactgatttttgtatattgattttgtatcctgaaacttcgaagttgtttatcagatctaggaacctttgggcagagactttggggttttctacgtatagaattacattgtctgctaagagagaaagtttgacttcctctcctcctgtttggaatccttttatttctttttcttgcctaattgctctggctaggacttctagtactatgttgaataggaatggtgagagagggcatccttgtcttgtgccagtcttcaaggagaatgcttccagcttttgcctattgagtatgatgttggctgtgggtttgttatagatggctcttattattttgaagtatgttcctttgatgcctggtttgttgagtgtcttggttattttatcaaaagaacttaaaaatacattttatttattacccaagtaatacatgtttacttttagaaaaatcagaagatatagattaaatcaaaagaaaaatacttactatgataccatgataccatcttgtagatagctgctattgtggtttgggcatatattcttccagacttgtaacttcacaataaattgtgtaaatttataacaaggtatataatttcttataaaactggaagcatactatgcatagttaggtgtaatcatttttctgactctctttccatgtcagtaaatatatttccctgtaatcattactaatggctgcaagacattccattgtatttatgtataaaataaataaatgtatttaataaagcttatactgatgaaaattaggtcatttaaaaactgtctttatatggagtttgtgccaaaaaacacaaacattttacatttacatttacatttctgtgagtccaatctgtcagtcttgttatggtttctgcatttgggatcaggctgaggaattcctccctgatacaaatatttttaaattattcagctctgttttcatctgttttaacactaaagactttagccaatgtagaatttttcttatgtgttatgagccaggaatctaactttaattttttctaaaaaactttgttaaataattcatccccctgctaatttaagatgctggttttgtcacaagcaataatccatataaataattaggtctgtccctaaacttttatatttagttctatgatctatttctgtgccagatttatactgttttgattatcgagggtttataatatgcttcagttgatgtctggttgagcaaaacccctctttttctcaaagttttttggcttgtctaacagctgatcatcttccagatatgtctagaataatttgtcaaattatacaaatattttacaacttgacattttattggaattatattaaatatgaagattaatttggggagagtgacatatttataatattgtcccatcaaataatataaaatatatctctattgatgaatcttttttttttaactcctaatcacgtttacatttttttttttttgagacagagtatcgctatgtcacctaggctggaacgcagtggcgcagtctcagctcactgcaacttcagcctcctgagttcaagcgattttcatgcctcagtctcctgagtagctgggactacagacacacaccaccacacctggctaatttttgtattttggtagagatggggttttaccatgttggccaggctagtctcaaactcttggcctcaagtgatccacccgccttggccttccaaagtgctggaattacaagcgtgagctactgcactgaggtctaatcacatttttagcttgtcatatagctactgcacattcttgttaagtttattttacaatatcttattctttgtttctattgtaagtggaagccctttctcacttgctctgatgattactagtgcaaatatatgtgaatctgattatatttgtttcatatcatacttgtaaatcatttatttgttctaatatatttttattttatttccttaggtttcccgtagaaacagtaattccattctttagatctcattttcctttcttgacccattgcatagattcaaacctggtctagaaaagtgctgaaaaactgtggtgatatcagggcttcctttccttattcccaacttcagagaggctttaggtcatcactgtccaatagaactttctgtaattacaggagtattctcccaatgtctaatacttgtggccactgagcacttgaactgtggctgatgatactgaaaaaattaattattttattcaagtaaaataatattattttggacagcacagctctaggttttttgtttgtttgtttgttttgagacagggtcttgctctgtcacccaggctggagttcagtggtgcaatcacagctcactgtggcctctacctcctgggctcaagcgactttcctaccttagcctcccgagtagctaggaccacaggtgcacaccactgtccctggctattttttttttgtatttttttggtatagatggggtttcaccgtgttgcccaggttggtcttgaattcctgagctcaagcgatccccctgcctcggcttcccaaagtactgagattacaggcgtgagcctgtatgtgcctggccagagtttcactattaattatttatttcagatgaatctttaacatgataaagtcagcttggggaaaagatcatgggttaaaaaaaagtaagagtattacgtagataattgtcaaacacatgcctttagcaggatgtgaaagggagtagagaatagcatgataactggagtgagatgagggttgaaaaaagctagttttttgtctgctttgttaagattaagtatggctccacatccaactctttatttatcttccccaaatataccatctcactgtattaccttctggtaatattgctaccattatgctactccaaaaccttgttaccactttttgagttctctttctcccttgtcccctaataatgcaaactctccctcattctacccccattcccacaacctgtatctcacccagttttcaagttccttcacaagtgtaccttctgcatgaaaaaacttgttcttgatctcctcagtgaaaagtagtcttgttcttcattaaaggtagaattaatttgtgtcttttttataccacttagtcctgcacattgtcttcttcctatttgttaacatatctatgagactgtacactctgaggatctcatccttgactccttgactgattgacctttctatccttgttggtccctctgctggtgtgctacatatatattgtatacctgtgcttagtaaatatttcttacatgaatcacaattcaacttgtattaatcatttatgtcttgtattcaattgacagcttctggagaacagggatcatatgtatttatttttgtatcttctgtgttacagcatgatactaaacattgaagagttgtttggtaattattttaaaatttttattcataaaagtcgtgttaagatgttttatttaggattgcattttgcttcatttggtggaaatccaattaaagtaacataaccaaacaggaaggtttttgtgtttttttcctttcaaataacaagaagcctagaggtagtcagtctaggggtggtatagtggtactaggttctcatcagtgtccccagtttttctgtccttaacatgtagcttttgtccttgagatcacatgaggcttttccacctccaggcatccatatttatgttgtttctgtccctttctattaggaaaacagtagcttttctggaggtctctacaaataaacttctgctcttatctctttagtcagaactagggtcaaacgggcatcttccagggagttttgaaaggtattattaactgggtgctttccatccacattaaattgggatttttttttggaaggaagaaagaaaaaataaatcttggatgggaaatctagagtctatatcttggatatggaatttatacttaaagccattaggatctacaagggcatgatatgatacatgtgaagatttcaacaaatcaagacaattttgtaataaattccatatgcacagctggacagtaagtgctatcaaagattagaggtagatgagctccctgaaagatggagttgactagaaaatcttcagtgtaagaggtgggacttgagcagacccttaagagataggtcaaatattatacagaggcattgagtgcttgttttgcaagtgagaagcactttttttttgtttttgaatcattagaccagcttagcaaaaattaatgcactcatattatagggcaatagaaaataagattggaaaataagttgagacaacataatggaggtctttgaatgccaccgtgaagagtttgggtttgaggttgttcaaacaagcaaatctaatgcaggtttctgaaaagaggaataatatgagggagtggaatagaaatgacatatattaaagtttaaaagaatcattcacagattagttcattcgaattaattaatcactaatgttatatctcctaccctgtagttaagttcatagcactttttttgttttgtttttgagacggagtctcgctctgttgcccaggctggagtgcagtgaggcgatctcagctcactgcaacctccacctcctgggttcaagcaattctcctgcctcagtctcccaagtggctgggattacaggtgtgcgccaccacacccagctaatttttatgtgtgtgtgtgtgtgtgtttgtgtatgtgtgtgtgtatatatatgtgtatgtgtgtgtatatagatgtgtgtgtgtgtgtgtgtgtgtgtatatatatatatatatatatatattttttttttttttttagtagagatgggtttttgccatgttgggcaggctggtctccaactcctgacctcaggtgctccactcatctcagcctcccaaagtgcgggattacaggtgcaagccaccatgcctggccaagttcaaaacacttttgagcaaagcagttgattctaaggggtccaatacctaaaacagatatttgatattgttacatttgaggccctgagttatagaatagtgaagctctagaaataaaattttctgttaaacttattttttatattgccaaggaattctttgcttctgttatcattacagcatattttaaatattgtatcagcatattttatcatattaatacccaactgtaatctttcttaattagcttgcactaaatgatttataaaatgattgaaaacacttgtgtgcttttgactaaatgtgttttattgtctgttattttctcaacctagaattttaagtctattgaaaaatacttaaatttcaatgcagttatgttgactgaatgttttattttcctttttaaatcaatcttaatatattttgtagtttcttttaagtgaggtgtgctggagcatttcccagatacaattatgaattttttaaaatgacagatgtttattcaaatgtaaatctcatcaaatagtaaagatttttatcttctattttaataatatcaattacttctgatggtttgacatagtttgagtagagaaacagtctgattcaattgaaacacataaaatatgcttgatataatttcctacataattataaatgaacttctgaagtctgagttacctcatttagtatttggaatatcagaaattttcacttcagaacattaaaattagtgccttgtgtctttagactctcctccttaattaccacaagatcttttctttcagggtcttattaatatgaatttgactctatgtaaaaatgtagatgtagaaataatttattgcagtttctcctaatcagttaaaattttagcattcattgttgggtactttttgattactgttcagccctatcccactgatgttgggtttggccataggatttgctttggtcagtggaatgaatgttagtgatgtgatataaagccttaaatatgcttgcatggtttggcttcagtttttttcactggtcatttgttatgagaagagctttccctgggcagctgctgccccttcaccttgggttccagaattaacacaagtgaatcgaacctgagcccaacctatagcctgaaccaagccacccaaccaaacccagcctagatcagtcaaactgtagtcaacatacagacttgtgagcatgaaaataaatgtttgttattgtaagtcactaaatttggggtgctttattatgtaggattgttgtcgcaatagctgactgatatgaccattactatttcaaaaagcacatctatatattttcattaagaaaaagtaaaattatagatggctaacctatcagttctctattaattgaaaagtagtaacacttaaaacacgaattataaaacaccaattatttgagagtttttcttggctagtggccattacaaattttattgaataaaattctttttttttttttttttttaaacacggtctctctctgttgcccaggctagagtgcaggggcacaatcttggctcaaagtaacctctgcttcccaggttcaagcgattctcctgcctcagcctcctgagtaggtgggattacaggtgtgtgccaccacacctggctaatttttgtatttttagtagagacaaggttttcaccatgttggccaggctggtctcaaactcctgacctcaggtgatccactcgcctcagcctcccacagtgctgggattatagacataagccaccacaccccgccagaataaaattcttgtaatggaacttgaggaataagttgttgaggtacttattattagttttaaaataaacctggctggcactacaagtaatcacaaaatgaaatgacataggaaccatggctggcatttgttaagggcctggccacacaagtgtttggcattcttctcttctcctcacagcaaatctgtcaaatctgtcaggcagtcaacacatatttattgagcccttaccatatgccaggtattgcaaagtatgtattaccctatttttgttgcatgaagaaactgaggctcagaaaagttaaatgactagtttaagcctcacagctaggaaagggcttgagttttaggacttgacccaagtccatctgactccaaaaatcatgctattatcatcactgtgttatttgtgtttgggtggaactaggagaaaaatagaattacaggccaggcgtggtggctcatgcctgtagtcctagcactttgggaggccgaggcaagtggatcacttgcggccagaagttcaagagcagtctggtcaacatagcaaaaccccgtctctactaaaaatacaaaaattagccagttgtggtggcacatgcctgtaaacccagctactcaggaggctgaggcatgagcattgcttcaacccaggaggcggaggttgcagtgagccaagattgggccactgcacaccagcctgggtgacagagcgagactctgtctcaaaaaaaaaaaaaaaaaaaattacaaactgatttacctaacatttgttggtgtgttatctctagtcatttgctacataacccagaggtcacccagaatcactttagcattcagaaatctacatataaattagctcagacccaaattgctgttttttagcatgtgaaagtctgaagctgtccgtacaatttctactaattccccggccttacagtcatgtggtccccttcatatgtccttggaggccaccttgatttgccatgtcagtctgagtgtaaagctcaaccctttccagtttctaccagacataccttcaccaagcattttctgagttttggtgaggacctccatgcaaaacacgagatctccaccattctttccctctcaacgttgccccttgattgcaacaccatgccccttttcatattctttactctctgttttgcagattagcttttcccttctattgaagccttgatagcccagatacccaacaactttggagtcatgcctctaccctcaagctggagtgtcagtgagtgccttctttgactctgtctcattacaaagcaaaaatagtgagattctcttgggaaacagcatcagttggaattagtctcatcagtcagacagcccccatttagctcaattttaatttttaaaatggaatttcattgaattttcaacattgacaattttgttcaactaaccttaaatggtgagaaccgaaagcatctaatataagagctactcttttcttcttagattagaaataagatactttacataactaagaaaaagtctatctttagaattttagttacttcctacctctttccaaaaatgtgacttataaaaactacagaataaatctggatataagctttttctgtagtttttcccagaccacttttcctattagctattcagagtgaattttaggagcttgaaaacttgatatgtttatgagcccagaatttagacactgctataaatttaaattgtctgaagcacttgattctacaacactgtgttggaaatggttgaagaactgatttccacttctggataagccaaactactctcttatcttgcaaatttgccactaaaatcttaattcctgtcagaattattttcagtgggagaaatctgagtacaaattgaccaaaagaactttagttctcactcatttctaatataattttaattagttcatctttaatttaggaaataatttttctagcaacttggcagacattggtttcttgccagatactaccttatcttgagcttgtgggaaactcatctttaatattccatgagtatagtaaaactgtgtttttaacgtaacaaatattgttttatttattaaataaaacatttatttgggggtatattcttacctaattaaagagaatgagtaaaagatgaggcagaccctgaatgtgagatgcgtttgaaaatggggtgtctcaagattctgtaccgggacattggggttaggcttctaaatactgttagtccagtcttattactaagattgcataaagagcattttatttttgtgtgacctagatcaaattattttgatgtaggatttttcttctcagtcactttccaagtccccagccagcaatgccccacccaggcctcattcagccacactggcatgccccagttttcctgtggtatagcttgtacctgtgttcagcagttcccgaactcttgtcctgcacccaagaagaatgaggatgtgctaaacattgaagggtgaggaaggtggagaagaattttatagagctatgaaacagttttcagcagagaaaggatgcgggggttgtccccctacccaaaggtgggaatgtcccctgtgcagccaggcatggggccttctatggactcagaatggggagtgcgtgctgattggtttgtgtgtatgcaaaaaaggttaaagcaaagacaccactcaaaggtgggcatgacagtgtagaaaaccaattagaaaagggtaggtatatgtaaaataggtgaagggtggggatcaatcaaaggaaagcatgccaaacaggaagacaagttcttaatccagtctgaggatttaacttgtagcttggctttcaggctttaaactttcttcgccttggaggtggggtttcaccgggtaccagcccgtctgcctaggcatttggctgcctcctttctgtatcaatttgaccttcctaaacttcttattcgttatcttttaaataagtattatgtctgccctccctaccttaaaacgttgtaaggtttagatgaaagaaatatacatgaaagtactttgtaacgtacagtacctacagacattagtgattatgtttgtggggcaaaaaaagtaggcaggatggaagaaaggaaagcaaggttgctcttaaattcattccagcagtatggctggaaatgaataatcttcaaatcctgagcagttgcaagataaggaaaggattaccattctgggggcacagcaatgacagggccctttaactggccacagtgattgccagttccaaccatttcaggtaatattgtctacagtgtgctgagtgccatgttagttactagggatacacaccatgacaagaaacagtccttcgccctcaagaaattctctatctggctgtggacaacacggctgtgtgtctctagcaggggtgagccaggatatggcaggctgggtggagcatggttggagcagaaaaggagctggttattgtgacagggtctggcatgttttttccatcattaaatggagtgatttaaaaataatacaccatatttatatttttaagtcacagagaaaaacaagggtgttttaaaatttggttaattacaaaatcctgtaataacactttttttttcttttaatacatggggagtgacagcatcagcatgatcttctttacagttttgtcatgttttaggattttactatgctcattttaagtttcagggacattattgtcacgatgaagttctactctgttgcttgttggtgttctagtggtgcaacactaactctttggatgtcatttttaacttcgtcttttgtattcaaaagttgaattgctagtgatctttattttggtagtttttaaaggaaataagtgtataatatattatccatactaaatgagaggacccactgacaaggattacttccaattaatggtaatcattttggggtctggaataccttaagtattttttttttacttgtttcttagacaaataataaaataagcttttactttctgaatatacaacaacagggatggagtgaggggagacattccagaagatgccaatagtataagttgctaacctaggattaataactcattgcagaaaattcaggagatgacggtctagtctggtactgaattaaattatctacggtatttaatgttttactctagtagatttgctggtttggtgtctaccttaacttaaatatttagagaaaaatatggaaaagtttgtgagaaaatgaagtcttgtataaacatccttgtcctaattgttcacctttactgcagaaatcccagactggcaccagtgtggccgaagttcacactgtgttactataaatttacatgatgtagtggatgtcttaagaggtggaggcaatcccatattcaaaattgaaaacaaaaaaaatatttaaatacccaagtgagtaaaaatggactctcctggataagtctggaccatctttcaaagatattgagcgtctggaatttttatgtgcatttcgaggctgcagtttcctctgacagacaatccattgttattactggctgtaggcagtcctgaaagggcagagtcaggaaagacaaagaatttacagtacagaactttcaataatgtgttgatgtcaggaaaagagttgagccatttctgataagaaagaagtgttaatgttaagcagctgtaaatgtactttctgtgatctactcctgcaaagtaacagcagggtatttcttaggcttgggtcacaggatgaatttgagtaatcaatccttaagtgaaagcaaagagagaatactggaagatgtgacagaggtcagccctgggaatggaacatgtagtcttttccaatttgatgttcttgtcccaggtttagatttggcagcagctacctccctcctttaagtcctcaccaccattcccttacaacaaatcaacatttatcagtaactgtgaaagcacagtatcaaaattatttctaaattagagtttgagaaatgattttgaaatttatatagcattcctagtactcaggccaactcttcatagcaacacactcattttgattcttaaagaaatgtgatatattttttcctaaatagatttaaaattttaatcaacacatttggcttatatgatgaaaaactgcctgaggctatggaattgggtaagaacttgttattttggtgaaggtgcatatattctgaagacgtatctgcaagccattgggtacaaatactgaatgtgagtaaaatttggaagttgactgcttcagggttccaaattgggccatcaatattaggatatatataattttaaatccagtcttaaacctgtgtatgttcagaaaatcttttgtcaaagagtgagtaataagtttctatttttccaaaagcagtttaactaagtattaggtgttcagggaccagattcttattcgagtcttatttttaagagtttgaagtcaataacttattttctttgtccctcatctcttttattccacttataaagtatgcacactgggctgaacaaagtggctctcgcctgtatcccagcactttgggaggtcaatgtgggcagatcacgaggtcaggagatcgagaccatcctgaccaacatggtgaaagcccgtctctactaaaatacaaaaaattatccggttcatggtggcgcgtgcctgtagtcccagctacttgggaggctgaggcagaggaatcgcttgaacctggaaggccgagactgcgccactgcactccaccctggcaacagagcaagactccatttcaaaaaaaaaaaaaatatgcacactaattctggctctcctgcttttgaaggtatcacacatataatactctttgtgataaagccttaaattatcagagtggtaatactttaaggctttattaatccaaagtaagttgtgatattttaaggctttatcaatccaaagtattgttacagatatgaatagtggtacctacattgcatagaataggaactgaatcatgtaaatcaatgctacatcatttgaagtcttgcaggaatggacaagaccagtactcaaagctaacaatattttggcctgattttacataactttcaaatcatcttctcagaaagctaaaccccagctgctcttcaagataagccatgatgacagagtagctataaaagtagtgtctcatagataaagagaagtatgaacaggttcaggctggctgaataatagcccttttctctttgaaaggaaatggaaggaatgtagctgtatttgcaggtaatgaatttcaatcccttattactttctttgggacacatttactacacactgcattaggaaggaggaatttacatttaagtatggaagtggatcagaaattagtagatatataagatcaggcagatctttatcattgagcaaaggtctaaagatagtagtgcagtctgtaattctgtaagtggatatattggaaccataacaacagcaacagctaacatttattaagtgctcattatttattagatacagtattatgtatcatctgttattcatgtgtaaggcaggtagtgtctttattcccattttggagatgaagaaatcaaggtatacagtagttaagaaacttacttaaggtcatacgatctgtgctagctttcagattcagggaacttgacttcagaaaccatactcttaaccagtatgccaaaccaccttctatgaatttgaaaccacctcccatgaattgatgaattcataattcatcagttggtgttaatggaagtggtggaatatagccctgaggccaagttctaaattgtttaggaagtgacccaaatactgagataatcataacaaaaaaagaggagagaaaagaaaaaaaaggaaggaagggagggagggagagaaagaaaaagtccattccaacaggcactgggtattggatattatgggagtctcccataaagtataaggggcccataaccaggggactgagacttcacagtaaggaacccagccagtagaaactgggatacagggcaaggaaactttccagtaacagtggactggaataaaatcagagcaaaatcagagataaaataattcaaagtagaggcagcatttcttgacaaaagatttcttatgttatctcccctactgagggctgaagttggccccagagtgagatgcatagttataagtcagggttaatgtaatagattcagctcagaggcaaacagaagcaagggcaccgagccaggtaggccattacaaaatggcccaactgggttagagttccaggcaagagacttattttcctaactttactaacattatttctccattgtggcagctcccgcttctgtgggacatggcatcatgtagcagtgacattagatacccaaagactgtggaacagggagatgaagtttcataacataattacaaaatttaacagcaccctttcacatattttatggcccaatctatgttgttattcttttattattttttaagaaatgtagtatgttatgtaatatactgattgcagagttcacgaagccatttgggagattactgggaggaataatttgatatgaaattattatttaattatatcactttcttattctgtcttatactaacttttgcagaatgtatattatttggagagccttgtttgatatccttaacagacagagtaaacattcaagatagtacttttaggagagtagtttgaatagttttcatttgctaattccatcctcttttttctgtgaaagagaaaaacaaaaacattttattttgttttctttcatgtagtgtttatccattgcctccatattttataacagcaccaaagactagtttttctgttctgtttaaagctcatagtttcttagaactagttgtaaatactgttaagagtcccccaaacagttttttaagaacctaatttagtttcatttgtactaagaagctgttttctagatgactaacatcatatagtgttgtttccatcaaaaatattagtctggcatttgtcatgttctgtccactaaatagctttgttattattgaggtctaagctctgattttttatcttatccaaattcctaccttaggggtctagggagtcatgtcctacaaaccataaattctcatgagatgggttttatttgaccctatatattgtgacttacttttcagtctgactctggcataacattatgagacaaggaaaaaatatttaaccccaaaatatatttccttgttataccttgaaattgccctgcaaagtttcttgtgggaaaaatccacattctatagagaatccccttccccttttgttttccttcctttctttccagatacaggagttaatcaactaagaggtaggcacccttttaagtcccaaaagaaacaatttacaacccccgctctctctgaagtctgctatctgagagcttcctctgcacaataaaagttggtctccacaatcctttaccttttttttgtttcgttttttgtttttttgagacggagttttgctcttgttgcccaagctggagtccaatggcgtgatctcgactcaccacagcctccgcctcttgggttcaagcaattctcctgcctcagccgcccgagtagctgggcgccaccacacccggctatgcgcctggccacacccggctaattttgtatttttagtagagacggggtttctccatgttggtcaggctggtcttgaacttccaacctcaggtgatttgcccacctcggcctcccaaagtgctgggattacaggcatgagccactgtgcctgcctcaatcctttatctttaacctgaacattcctttctgtcgatccaagtctttagacaaactccaccaattgtcaaccagaagatgttggaatttatttaaagcctggaagccccgctttgagttgtcccacctttctaaatcaaaccaatgtatttctttcttttcttttttttttttttttttgagtcaaagtcttgctcttgtcccccaggctggagtgcaatggcacaatctcggctcactgcaacctctgcctcccggattcaagcgattctcttgcctcagcctcccgagtagctgggattacaggcgcctgccaccacgcccagctaatttttgtatttttagtagagacggggtttcaccatgttgaccaggctggtcttaaactcctgacctcaggtgatctgcctgcctcggcctcccaaagtgctgggattacaaatgtggagccaccgcgcccggccaaaccaatgtgtttcttaaatgtatttgattaatgtctcatgccttcctaaaatacatgacaacaagctgtaccctgaccaccttgggcacacgttctcaggacctcctgagagctgtgtcacaggctgtggtcactcatatttggctcagaataaatctcttaaaatattttacagagtttgactcttttcgtcaatattatgaaatgtgtctgagatacatatacaaaagaaaaatactaagatatagcatgcatccaagaaatgcagtatctttctgttaacataaattatctaaattcatataattcatgtgcatttctgagtctcatctcacatcagacaggcagcctgagatgaagaatgagcacgggctcaggttgggacctggtaaaagcaggcatcaccatttaaggagcagagacctctgctaggttgtttcacctctctgagtttgtttcctcatgtatcagttgggaatgatatcgaatttgtatcatccttatgaaaaaacaaatatatatgaagttgcaaatataggttttcaacaaaagttaacagctatcactcattggcatctagactttaagatgattccactcaagagagcgacataattctaaataagaaaatgcttttgatgtaagagtccatttcctgcctctcgggcacgccaccacagcctgaggctccattagctgttgctatctgcagttagtgatttagcttggagcatatcgggcgctgtactaagtgatctacatatgttatttcatttaataacagcaatcctttcaggaaattttggtttctgactttctaccatgactttgacctatgtacattttcttttagactatgtattcttttgacttttgtctgccttattctagccattgctttgcacaaattatggcactttatgtcatcaaaccatattagttaggaggctgtgggatgcaaataacagagaaccagacttgatctgtcaaaaaataaagggaatttttttcatatacacaactggataattcttcaccgggttctatctctgtgattcttttcactctgtcttcctccatggctctgcttgttgtatcagaaatggctgcagcagttcctgacatgacatctttgtactacactctccagaggaatggagagttgctgttttcccagaaagaagctcttggcttccttcgacaggaccagtgtaggtcttgtgctacctctgacaccatcacttagaccaggggcttggggtcattgactggcttatccctgctcttccctgagtcaatcaacggacaagaggaatggtgttacattgcttagtttagacctacacccgaggttgtggtccatgtcacccaaatcgcatgggcatcatggagcaggaggtgaaatgggtacaggaaggccgtcttgcccccagtgtcaaaggaaatgggtattagtccattttcacactgttataaagagctgcttgagactgggtaatttataaattaaagaggtttaattgactcacagttctgcatggctggggaggcctcaggaaacgtacaatcatggcagaaggcaaagggaaagcaaggcatgtcttacatggcggcaagagagggagagcaaagggggaagtgccacacttttaaaccatcagatctcatgagaactcatttactatcacaggaacagcaagggggaaatccgcccccaagatgcagtcacctcccaccaggcccctcccttgacatatagggattacaattcgagatgagatttgggtggggacacacagccaagccctatcagaatggttacaacatttcacttttaattatgacatgttgctagagggtttcttttaaaatttttttatcagtttaaggaagtcatcttcacaattaagtttttttttttaatcatgaatggaagttgactttcatcaaatgttttttctaaatctgttgagatgatcatgtggatttttttctttattctattaatgtgataagttacactcatttttaaaaacaactttagctataatggcatataataaactgcacatatttaaagtatatagtttgatagcttttgacatatgtgtatacctgtgaaactatcaccataatcaaaataatgaacatatgtatcattcccttccaaactttttttttttttttttttgagacagggtctcacactgtggcccaagctggagtgcagtggctcactgcaacctctacttccctgggctcatgtgattctccagctttagcctcctatgtagctgggactacaggcatgagccaccacacctggctaacctggctaatttttgcattttttgtagaaatggggtttcaccatttcctcaggttggtcttgaactcctgagctcaaagtgatctgcccaccttggcctcccaaagtgctgggattacaggtgtgagccaacatgcctggccccaaacattttcttatccctcctgtaatccctgtctccagccccttccctcctacccctgctccacacctgatctactttctgtcactacagattagttgcattactaattgaagttttgaaggttaaattaactttccatttctgaaataaaccagtttgatcattatgtattagctctctctcttacattaagggaacttcaaaaaggtcacgggaaaatggaattaaaagataaaaagaaaaaatataaactttatttttcaacataagctctgtcaagtttaagacacttttataagtgacaatgtcagccatttagtccatccctaaagaactgagggtcctgggatttaaccatgtcagtgcagtctttttcacattagtaactgaagaaaagtgggtgccctttaatgatttattaagattagggaacaaaaagaagtcagaaggagccaaatcaggtctgtaggtggttgcctaatgattttcccgttgaaactctggcaaaattgtccttgtttgatgataggaataagaggagtattgtcatggtggagaaggaccccctgttgaagctttcctgggcatttttgtgctaagcttttggctttctcaaaacactctcattgtaaacggattttatcattctttggctctccagaaagtcaacaagcaaaatgctttgagcattctcaaaaactgttgccatgacctttgctcatcactaatccacttttgctttgatgggccacctctacatcttggtagccattgctttgattgtgctttgtcttcatgatcatactggtaaagccatgattcatctctttacaattctttgaagaaatgctttgggatcttgatcccacttgtttgcaacatccattgaatgctctgcttttgtctgcagctgatacgaagtgcaatggttttggcacctaccaagtggaaaatttgctcaactttaatttttcagtcagaattgtgtaagctgaaccaattgagatgtctgtggtgttggctgttattttttcggttaatcattggccctcttcaattaaggcatgaacaagattaattttttccttaaaaattgatgcagatggtctgcccactgtgggcttcatcttcaacattgtctcatcccttcttaaaatgagttatccatttgtacactactgatttctttgggggattgaccccacaaagtttttgtaaagcatcagggtttagccattcttccacccaagcttcaccataaatttaatgttcttgtttcaattttagcagaattcatgttcctctgatggggctcttttcaaactgatgtcttatccttcttagtgcctcaaactagatcctgttcagacattttatgacaagttagcataagtttattctgatgcaaaaaacccctgaaatctatgcataggtttttcaaaatacacattttccataaactttttgaagacccctattatttctgtatttgtttaaccaacattttgcttctatgtttataaatgagattggggtgtaagttttctttctagtaatgcccttctcatactttagtatcaaggttatgctagccttgtaagatgagctgaggatggggagaatgtttcctattctctgttttattctctggaagaatttatataagacaggtttttttttttaattaagttttggtttgaatcaaccagtgaaacctcctagactcacaagttttttttgttctgttttgttttgttttgagatggagtctcgctctgtcacccaggctggagtccagtggcgcaatctcggctcactgcaagctccgcctcccgggttcacaccattctcctgcctcagcctccagagtagctgggactataggcgcccaccaccatgcctggctaaatttttttgtatttttagtagaggcagggtttcaccatgttagccaggatggtctcgatctcctaacctcgtgatctgcctgccttggcctcccaaagtactgggattacaggcgtgagccaccgcgcctggccaacctatagggttttttttggaaagctttaagttattaattcaattttaaaataaataaggggttgttcacagttttcttcttgtgctgttagtttttataaaaggtatgttttcttgactttttaattgactgtatgcacgtaatatgcatgcagcatgagcaatgagagtgagaccctgtctcaaaaccaaccaaccaacaacaacaataaaactctataagctctgtagtgacgtttcctcttttatttctgatattggttatttaagcttgctttctgtatttcttcattattctccatgggggtttataaatttattcatcatttgaaagaaccaacttttacccttattgatcttctctattgtatttttgttttctgttttacttgttgctgttatctttttatttccttccttatattttctttagatttctggaattttttttgtttgttttttgttttttgagacagggtctcaccatgttgcccaggctggtctccaactcctgggctcaagtgatcctccttccttggcctcccaaagtgctgggattactaaataggtgtgagccactgtgcccagcctattttatttagatttaagttgttcttttcataactttttatcaaggatgtttagcttattgcttttcagcttttcttcttctctaatatatgaatttgggggccataaactttactcgtagaatagttttaatggtgcacctcataaattttaaagaacatttacttcaaaatgggctctaatttccactgtgacttttttctttggcctatgggttattagaaagtatatttcttaatttataagcattgtgaattttctaggtaaatttttgttattgatttctagtctaatttctttatggtaaaataatttgttttgtataaattcaattctttggaatttgtggcaatttgctttcacatatgattttgataatgatctatgcatatttgaagccaatgtgtatattctgatgtttcaaggtagagtattgtatttgtgactattaggtcaaatacgtaaaaagtattgttcaaattttacatatcgttataaattatctgatatacctgagagaggtatgttcagatttctcactatgatttttaaatttctctgttttgtcaatgttgtttaatatataattttgagctatgttactaggtgaattaaaatgtagaagtattatctcttaatagagaagttaaagttttatcattttgaaatgcagttgtccctccatatccataggttccatatctgtggattcaattggggatcaaaaatatttgggaaaaaattgcatctgtactgaacacatacagactttttgtcttgtcattattccctaaacaatacagtatgacaactatttatatagcatgtatattgtattaggtattataagtaatctagagatgatttaaaacacatgggaatacattatatgcaaatactattctgtcttatgtcagggacttgactatccatggattttggtatccataggaggtcttggaatcaatcccacatggatacctgaaggccttctttgtctgatataaatatagcttatatgctattggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggagctcctgtaccacccctaaagatatcaataatttctcattctccaacttttagttttcccatttttattggtcctcaaaactttgtctttgcggcactccctgcctcatcatacttgtgacaagttgaattcctaagactcaggctcgtattacaaaggatgcaatttagatgagcaactccctggtgagatgagtggctctctggcaaacggggtggggaacatagagaactaagagtcaggaaacttggggcctatatctagggcatctgttacctaacattctgacccagactatgttttccttgcttcagtggcttaggctgcaaaataaggtccctttcacctttgacacataatccagatcttgtactttactttagtaattttagaaagaagacatttaggccgaggagatgaatgtctgttctcattgaggtaatgaggttttctaccactttatttttcttggtaaagtctttgcttataatctggcagcctttatttgtattcctttttcttcctttggctggctggagagcaagtgccattgacatggcccaaagagtatcatcttttcagccttggagcaaggagtctcagagtagagcacccccactccctccccaaatgcctgtgaatgacaaggcaggaaaaacattttttaattaagtcaattcagttgttacaagttgaattaatctctaatttagggatatcatgggaaactatttataatatatgccagctgacccttatccaaatttccatggaaatagcaatgttataacacagggtgttcttggactgctctaaaaattccagctggtttaagtatgatattgaaccgaaaaatgaagccttctactaacaaatgtgttgaagtatgcactcaggtgctcaggaggtataggcttagcttgaaaaaattcaaggcatgataccctgggctttccctcaaacctctttaattaagacctctgatattgttgtgttgtttctatctgaagtcaaatgggaattgcagaaagttttgcagttttttttttctcctccatgaggtagagattcgtctatgccaggagaagtgaagatagtcacgtctttctcttgaatgatgtaataaagttttgcaagggataaaccatgtttcacttgtatcagatttatttatcaaatgtgttgccattaagagtatgaaaatatttcagctgaggccaggcgcagtggctcacgcctgtaatcccagcactttgggaggccaaggcaggtggatcacctgaggtcaggagttcaggaccagcctggccaacgtggtgaaaccctgcctctactaaaaatacaaaaattagctgggcgtggtggcaggcacctataatcccatctactccagaggctaaggcagggagaattacttgaacccaggaggcagaggttgcagtgagccaagatcacgccattgcactccagcctaggtgacacagcaagacactgtatcaaaaaagaaaaaaattcagctgaaataatagcatatgggagaaattagccatgtatttataatacgcgtagtaaaagtgcagacgctatgactatattgcatgcttggtgaaagtaatggcaggtttgctatgttcaaaacatttgaattaatctgttcaaaccatgcacagcattacagaattgacattccagcacagtgactgcagtctgcagcagttgcagttttgtcatctatacaacgtcaaacaagatgcaaaccaccaggcttggtagatagaataccctttgagaattaagtaatcctgagatgactttgctcatcattgatgtcctgtgacgtcaactgaaggcttgtcttgcccatttcaccttgtcattgtggttattggttttctccattaaaatggaaaattggattatatttagcagaatgaacatatatttgatgctttaggtaaaatatatacagtcatatgccacataatgacttgatgttttaggtaaaatatatacagtcatatgccacataattcaacattttgatcaacgatgaactgcatatataacagtggtcccacaagattaaaattaatatttttactataccttttttatgtttagatacacaaatgtcattgtgttacagttgcctacactattcagtaacatggcatactatacactccattgcactccatgtgcgccattgcactccagtctaggcgacagcctaggtttgtagcctaggagcaaataggttataccacatatcctaggtgggtagtaagctataccatctagattcatgtaagcacagtctatgatgttcacacaacagtgtaatcacctaacgatgcatttctcagaatgtatcccagtcattaaatgatgcatgaccgtatgtattatctgaagttagcaccctttagcaaactcctgaatcattaatttgcaaccctttggttacatcttttttcttaccattataagaatttgcttaatatgaatttgtggattaaagtgatttaaagtgctctctatatcagggagattagccctttgtctgtgatatgagatgacaatattttttcccaagtttgacatttttcgtttgaaaaattttttttgtcatgtagattgaaaatttttttccagtacaataacgcgtttaacactggggatacattctgagaaatgcatcattaggcaatttctttgttgtgcaaatattgtagggtagacttacacaaacctagatggtagagcctactacacacctaggatgtgtggtatagcctattgctcctattttacagacctatatggcacgttattgtacttaatactgtaagcaatggcaacacaatggtaagtatttgtgtacctaaacatagaaaaggcacagtgaaaatatggtattataatcctatgggaccattgtcatacatagtccatcttatttatttatttatttgttcattcattcatttattttttgagatggagtctcgctctgtcgcccaggctggagtgtagtggcgcaatctcagctcattgcggcctctgcctcccaggttcaagtgattctcctgcctcagcctcctgagtaatccccacaatctcagctcactgcaacctctgcctccctggttcaagcgattctcctgccttagcttcccaagtacctgggattacagatgcatgccaccacggctggttaatttttgtatcttttttttagtagagatggggttttaccatgttggccaggcttgtctcgaactcctggcctcaagtgatctgcctgccttggccttccaaagtgctggaattactggcaggcccatagtccatcactgatggaaacactgttatgctgtgtgtgtgactatagttgttgctgttttttttttttaatccacagctgacctgaaagtcttttatgtctccagattttaacagaaagccttccccactctgagttagtagagatagtttcctttgttttcttctagtattttaattatttcatttttaaaatttaaatctttactcctttagaatttacctggtatatagtatgaggcatgaattcaacttaattttattaaaaacacctctccagttttctcaagacaattggagttgttcgtcttttcctcactgatttaacttatgtatttatgtatttatttatttatttagagatggggcctcactctgtcacccaggctggagtgcagtggtgcaatctcagttcactgcaacctccgcctcctgggttcaagcaattcttgcgccttagcctccccagtagctgggcttacaggtgtgcaccaccacacccggctaatttttatatttttagtagagatggagtttcaccatgttggccaggcttgtctcgaactcctgacctcaagtgatctgcctgcctcagcctcccaaagtgctgggattacagcactcccaaagtgctgggattacagtggcatgagccactgtgcctggcttagataccctgtgtatcatacaccaaattctgtatgcattgagatctatttctgaatttcctgttctgttttcttgatttgtctattcctgtgtcaggaatacaccttcaactattgtagctttatattattttataataaatgctaggaattgtccccctcattttattctcttttagagatttctttgaaatccttgttttatttttttctgtataattttcatttttgaattgacacataataattgtacatattaatggagtacatagtgatgtttcaatatatacaatgcttagtgatcagatcaggataatcagcatatccataatctcaaacatttataatttctttgtattggaaaaattcaataccctctcttctagctatttgaaaatatgtaatattgttaactatagtcaccctatagtgctataaaacagaacttattcttcctgtacagctgtaattttgtgtcctttaacgtatctcaccatcttccccttcccccatctccctatcctctagtaacttcttttctactttttacttctaagagattggctttttttttagctcgtgcatatgaatgagaatatgaggtgtttaactttctgttcctggctattttcacttaacataatgttcttcagtcccatccatgttgcaggaatcacaggatttcattcttttttatggctgaattgtgttccattgggtatatataccacatttccttgattcatttatctattgttggacatttaagttgattccttatcttagctactttgaatggtgcagcaataaacatgggggtgcagatacctcttcaatgtactgatttcctttcctttggataaatgctgagtagtgggattgttggttcatatggcagttccatttgcagttttttgaggaatattgttctccatagtggttttgttggtttacattcccaccaacagtgtgtaagtgtttccttttctctgcatcgttgttttttgtctttttgataatagctatcctaactggggtaagatgatatctcactgtggttttgattggcatttccttcatgactagtgatgttgagcttttttttccatgtatttttttggataaatgtatgtctcttttgagaaatgtctattcagatcatttgcccattttttaatcagatttttttttttttgctgttgcgatgtttgatttccttgtatattctggatattaatcccctagtggatgaatagtttgcacatattttctccattctacaggttgccttttcactctgttgtttcttttgatgtgcggaagcttttcagttggatataatctgttcatttttgcttttgttgcctgtgcttttgaggtcttattcataaaatcttgccccagaccaatgtcctggaacttttctcctatgtttttctctaggagttttatagttttaggtattacatttaggtctttaatccacttgaagttgatttttatgtagagtgagagatggaggtctagtttcattcttctgcatgtggctatttagttttcccagcaccatttattgaaaagattgttctttcccccaattaacgttcttggcatctttgtcaaaaatgggttgcctgtagataaatggattaatttctgggttctctattctgttctactgatctgtgtgttattttttaatgtatactttagaatttgtttgtctcattctcccccgacccctacccttctccaatttttggccttgttactgtagttataattaattgctaaattagcttagggagaacaactttatgaggttgagtcttcctatctaactaacttggtatgtcttcccctttgtacaagtctttgtgtcttcaggaatgccttaaaattttattagtaaatatggcacatttctaaagctttttcttaagtatttcatctttttctgttgctattgtagatagtcttcccccatttcatcttccaactttctgtgtttgtaatctaaaatctattgatataataattctctatcgtgctgcctaagttttcttgtttactttttcaattgaatgtcatagggttttctatattcatcagaaattgtagtagttttattatgttctctaaatttttatacctctagtttctttctcttagtaattgtattgtctaatatctaatatctaggatgttaagtaatggtggtgacaaatgagcatccttctttgttcctgaattgagtgggaatacctctagtgttgtcctgctaggcataatagttactttgggatcaaggtatattttatcaagttaagaaggtatccacttatttctaccattgatttcaacatatttctaaatcatagtaaagccccagggctatgtacctgcaccatgataggataaaagctctaaaaggaaagacacttaagaccctctagtctaccttcctcccatcatgagtattaaattccaagcacaggaaggttgtaactattccctgccccaaagtcctaaaattagattagaagacaatttggaacactgtctcttaggtcttatagcagcgttttttggggtatgttaggctaacactatttctctataacattatttctcttcctttgtgctctctccttgagatttttccattttatccttctcttctcatctcacttctgggacttcacgtgtattgcttggctgtgcattcttcctccagcctgccattgctgacaagccaagtttatcttaggagagttctagacagtgacataatcccttccccacccaaaaagactctttgctatttgctcttcctggacaaagtacattgtcttccaaatgctgttggttacatctggaattaaagcagaaagctcattggagctgctgaacacctcaaaatatacttcagtttttacagtgcctttagcaaggtgattttagccaacagtgaaagtatcataggcactactgtatcttatattcatttgtaggtggtattcagatttcaaaagaaattgtcataatatttattatatttaaatggaaaacataaacaattacatattagtgctatacttctgattttagattcacctgtgtcataactttaacatcaaaattagtaaatgtttcatatgctaagaaaacttatatgcaaatggaaaaaatctaagccaattattattttcataatgttctactgtgaaacaaaagatagtatttctgtccatatgtagttatcagactctggagtcagatagacttgggttagaattctggatttaccaccacctggctgggtgactggacagaagtaacatattctcaactgagtctcacattcctcagctgcagaatggggacagaaatactttgtacagttatatgagaattaagaaaatgcacacaaagtgcttagccagtggctaccatgccctaagactttaacagatgataactattaccatagcctattgttaatggctgtaataaagcctgttgtttttaacttttattaacttaaagaataaatgttgcagtttgactcagtgtgggactataattgcaaagcaactcatttatccacacagcctcctttctgagaattagaactaatgtacttagaaggatttgactgaagttctgctctggattttcttaggaattatttgggcaaccatgtccattaacacttatctagaaccgcaaggctgaaagtatgttattgtttgattaggttttcattagccaattattatttattgaccatatgataggtggaatagataagtatcacaaaagacatacgattcctactctacacatttagaactaaaaacagaagggcatctttgatttacttaaagggtccactttgtgctagatataataccatgccctagggatacatagatgaaaagatagccccctactctgaagaaacttatggtctagtatggtgtctagaatggaacttagaagccacttcttataggaagccttccctaaacttcaggtagggaaaatttccctcttatgtcatagcccccaagcttacacttaagtttggcatttgtcacactgtagattgtctgtctcctatgctagactgtaggctgcttgagaacagggactatgtcttactcatcaccgaagaaaagaagatgactaaaacatcatcttggcccttgaagaacttaaaattgagtgacaaatataaactacgaacatctgtaaacaactaagctcaaaatacatttttatgaattataaattctacagagtatatgctacaagaggtaggaggttttggaaagatgatttagaagatacggcatttcagtttagaaggaatggtgtgatttccatggttgaggtgggcaaatgaatccaaggttaaggaacatcatgagcaaaggcacagaatcgggactgtacatgggctacttaaggaatagtaaggagttccatgtgagtggactctggtaagaatgttaggtaggggattggttgtagctgatcttggatgcagtagtagggtgtttggattttcttctgcaggcagtggtgcattgacaaggatatttgagcaaaagggacatgattactttgtcaatagtgtaaatgatgggaaaagagagataatattcaggaaggggactcctgggactgccaataatgtagacaagaggtattaaggtgagaatagatatggaaagggaacaattctggaagcattgtgcaaattgacttgtcagactctaatttggaataagggcgattccaatttaaaagtccttatttcctacctcggtggagcttgcagtgagccaagatcgcgccactgcacaccagcctgggtgacagagtgagactccgtctcaaaaaaaaaaaaaaaagagtccttatttcaaaggtgatggctctagtttacattctccgtcatttacatgctctggccatggcatgggtaaagtcactcagaaagcgtttaaagaaaagccagagggaggtcacagaaccttgtggaaaacttatatttaaggggtaggtaaatcttcatatttagaagagattatgtttcaaaacttactaaaaagacaaaaatgggctgggcacagtggctcatgcctaaaatcccagcactctgaggccatggcaggaggattgcttgagcccaggagtgcaagatgagcttgggcaacacagtgagaccttatcactaccagaaaaaataaataaattagctgggcatggtggcatgtgcctgtagtcccagctactaggctggctgaggcagatcacttgagcccaggaacagtgaggctgcagtgagctgtgattgtaccactgcactccagccttggcaacagagcaagaccctgtctcaaaaaaaaaaaaaaaaaaaaaaaaaagaaaactcacatagttttcatcctttaagtggtttgcttaagttaacatctggtttatggcagagcccccaacccctgacatgtagctcagtgcactttctattttatgctctagattttagtttaatgctaaatgtgaggatatcacctaccttttccatcctcatctatcttagtaaaccggattaaatttgaattctggacccctctactttaagtatcttctatctcagccaggcgtggtggctcacgctataatcccagcactttgggaggccaaggctggcagatcacgaggtcaggagttcgagaccagcgtggccagcatggtgaaaccctgtttctactaaaaatactttagctcggcgtggtggcgcacgcctgtaatcccagctactcaggaggctgaggcaggagaatcacttgaacctggggaggtagaggttgcagtgagccgagattgtgccattgcactccagcagaactccgtctcagggcaggtgggtggggtggggggggcgttgaaagtatcttctatctcatatgttgatagctaccaatagcaaagagaaaattgtgccactggaaaacagggcaagtcatctatatggatgccacttaaaattatgtgatatgaattgatataaaaagcctaattaaatctaccttatgtttcaaaggcggtaagttaatcttttacattattgtttttatactctactctttatgtaaaagaaaaactacttcattttcaaatggtaaattattatcacccaaatacattgctgtatacagaagtggaaagattttgctcaaataagccaaagctaatgatttcattataattctatagaagtttttgttggtactaatactgtaattgtctatagcatatgccataggtattgtttgaaattgtttttatctcttaattatcaaatgaaatatacctcaaagagggaggcctgaaaagacatgaaactttgaaatatagagcatcttaaaaagcaagtacatggtgacgccagtcttcagaatagcatcatccctgttgaacagcataaaaaatatatggatttgatgatctatttggctggaagataaaaaatgaaccatcatgagccattattaaagaggtgtttataactgaaaaactgtgataaaggtcagttgacaaaatgagtggagcactgtaaatactaagagttgatggcccatgcctagataattcagtgtttctattcttagaaaatggattttaaccatttgaatgggcctagtaaatgatcctattacaattttcacatatcaattcatggtttacccaaaaagatgtgcagcatacttttaaattggcctttttctggcagagagtttccagaaaaataatgtgtttttttttgttttgaatttatttgcttactttgggtttttcttaagcaagaatattaaagtacaatatacatacagagaagtatgttttctaaatgtacaactcagtgaagtttcacaagttgaatatacttacttatccagcacccagatcaagacacaaaacatcaccagcgcttcagaatctaccatctcttacttccttccaatcaataggtacttaccaccctaaaagtttattgggagacaattctcccatgtgtctcatgtttctgcatatcttgtgagcaaaggcactgactgcgtgtgttcagaatgtctttccaaggcagccttggaagaccatgtctccagagcaaagggcaggtgtgcttatagtcttgaaaatagagattatgtcccttagagagcaaagaacaggtttacttactattcggtataatagagatgtctcccttcaaagcgaaaaggacaggcatgcttactgcccattataaaagattcagattccctatgttccctacaggagttcctctcctgtaacacaatccactgtatgtacaggtgtcacttgactttctgttgccttgtgggaattagagctcagggaaccagtgcaaacactgacactctgactattgagttgtaaggtcctttgtctctgacctagcatgtaaggctaacttgttaagcttgcaaggagcgtaaatctcagacccgtcactgtccttggtagtaagcactattctgacttctaccaccatagattagttttacctgctgttacacttcatacataaaagaattatatagcatgtactctgtctggcttcttacatccaacaacatatttgtgagattcattcatattattgcatgtaggcataattctttcttaatagtataccattgtgtgaacattttaaaaaattgggtttttttttccactattgatggacattagggcagctcccagtgtcagctattaaaattctgttgttagaaatactttatgcatgtctttgagtgaatatatgtatatatttccgttgggtatattcctagaactagatcagagggttcgcactggtgctgccaaacaactttctaaagtatctgtacaaagctgctctcccataaacagtatatgggccttttggtatctctgttattttcaacctttgttattttccatcatctttgttttgttttttttcagtgacatgcttcaattttaccatcatccattcataaggaaagatcccattggcataatggaattataccattggcataaaataaatatgccaatggtcgggcggatcacaaggtcaggagatttgagtccatccttgttaacacggtgaaaccccgtctctcctaaaaatacaaaaaattagccgggcgtggttgcgggcacctgtagtcccagctactcgggaggctgaggcaggagaacggtatgaacctgggaggcggagcttgcagtgagctgagatcgtgccactgcactccagcctgggcgactgagcgagactccgtctcaaaaaaaaaaaaaatatgccaatggtataattccaatttcacaaaacaatctcacaagcacttccactctttaggctgaggcaggtgaatcatgaggtcaggagttcaagaccagcctggccaacatggtgaaaccccatctctactaaaaatacaaaaattagccaggcgtggtggcacacacctataatcccagctactgaggaggctgagaaaagagacatgtcaattactaagttgttaccaggacaagttatcaaaaaggacaatgaaagccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctcgcgacacccacccctcagtctcgcgacactcactcctcagtctcgcgagtctgtggtggtgtctttacgtctttgttattttagccatcgtgctggatgagtaatgatattacatggtggttttaatttgcatttagccaaagtctaatgagctgagaaccttctcatgtgtttgttggccactaggatattctctcttgtgcagtatccgaggcttctccctatttctctactgggctgacgttatttttcatatggatttgtaggaagcctttgtacatgctagatactagtcagtcattcttccagtataggtattacaaatatttctcttccagtataggtattacaaatatttcctcccactctgtggggttacttttcttttggactcgtagtttcgctgtcgccgaggctggagtacaatggcatgatctcagctcactgaagctgccgcctcccaagttcaagcgattctcctgcttcagcctcccaagtagccgggattacaggcgcccaccaccatgcccggtttttttgtttgtttgttttgttttgttttgttttgtatttttagtcaagacatggttttgccatgttggccaggctggtctgaactcctggcctcaggtgatccgcccatcttggcctcccaaagtgctgggattacaggcatgagcaaccgtacctggcctactttttcaccatcttaatggtaccttttgaagaacaaaagtttttcatcttaatatgtgccaatttgtcattttcccctttaccttagtgtttttctgctctgtttaagaaatcttacctctcacctgggcacagtgcctcacacctgtaatcctagcactttgagaggcggagacgggaggatcagttgagcctaggagttggagaccagcctgggcaacacagcaagaccccatctctatttttaaaaagaagaaaaaaagaggaatcttatctcaccaagattgttcaaatttatatatgccatccatctggaattgatttttatgagtggggtcacaatttctttttttccatatgaatatctaattgacccagcactgtttattgaaaagacaattctttccccatgcataggtttttaaatgtttctgtcagaagtgacataaatcattggctacagctagtcagttggccttgtctaactttaataggacagggaggtgtaatcttctcttgagcctggaaggaggaaactggaaatattggcaagtgctgtatcactcatcatgaaaaataatttgagaaatatataaaagaccaatagaattaggccaaaggacatagagaaaaggtaataataaacaggagaaatttatgtaagacaatacagagcattaaccaaagattaataataaaaggagagagaaaataagcaatatttggagagaaaattatagtcacattgatggtttaaataaatataagacaggatgttagacagctttatgccaatacattttcaaacttagatgaaatatatggcttcatagaaatgtataacttatcaacacggactgaaatgcaatagaaaatctaaatagacctagagacaataaacaaatggaatcagtagcttaaaaaaatgtttccacaaaaatagcatgaggttcaaatgattttgaggcgactgctaccaaaccttcaaggaacacataatccatttttatatttattaaacattcaacaaatatttattaaacattcaacaaatgtttattgggtacctactgtgtgcctggtactcttataggccctctggatataacggtgaacagaccaaagatttcttccctcttggggtttacattttagcaggggagaaagataataacaagaaaccaatattgcacattagaaagttataagtgctatggaaaaaacaatagagcaaggagattgaaagtcctgggggtagggagtggggaggagattgtagtatgaaatagggtggtcagaggaagcctcattgaaaatatgagattttggcaaagagtcaaagaagttgagggagtcagctagtagaaatcctggaggagagcatttcagcacgagaagtgctaagcagaggcactaagacaggagcatgtctggaatgttcaagaaataacaaggaggccagcgtgactggagcacagtgaatgagggaggctagatcaagtagggtcttgtatgatagtgtaagaaatttggcttttattcttagtgaaatgggaaattactacaggattttgagcagaggacacaaaatctgacttaagttttgcgtgaatcactctggctcctgggtgaaaaataatctgtatggtggcaatggtagatttagggggatcttttgggaggctactgcagtaacccaggtgaaagatgtttctcagaccaggtggcagcaatggaggtggatggtggacatagtatgatggtagagtcagcctgatttaatggtaaattggctatgggatctcttagttcattttctgttgctgtaactgaatacctgagactgggtaatttataaagaaaagcttatttaactcacaattctggatgctgagaagtccaatatgctgtgctatgaagtagcatgacaaaaaagcagaagagcaagcaagcacctgggaaagaatggacaagagaggctgacttgcattatagcaacccactctctcaaaaactaatccattcccatgagaagttatccagccttgcaagaaaaacataaatccatcttaacaacctgatcacctcttaaaggccccacctcccagcatggggtgtaagagaaagagagaagtcaaggatgactccaatgattttgacatgagcaactggtaggatggagttactggaagcagagatggtgaaggttataatgaggaagatctttgcaggaaaatcagagttgtctctcttttttaacatattgtttgagatgattattggacaccagagttgagatgccaagtgggcataatgagtttagagctcaggagaggtctgagatagttattcacattttgggataatcagcatgcatggaatttaaagtcaaagggttggatgagaacactaagatagtgagtcctgataagctgggccctgaagactccaaaagtataaggtcaagaaaaagaggaaaaacagcaaggaagactgaagagagaccagcagggtaggaaggaaaccaagagagtgcaatgtgcttgaagccaaatgtgtaaaggaaggtgttcagctgtgtcacagggtgctcacatgtcagttagtatgaggtctgagaattgaccgtcggattttacaacaaagagtcactggtgactcaaaaagagcactttcagtggagtggtgggggttgaaatatgtttgaaagggaaagggagaaaagaaatggagattgaatattgacaattcttttgaggaatttttctccaaaaagaaacaaagaaatgggatcatgacaagagtagtcaagctactttcagtggagtggtgggataatagcttggctggaataagtttaagagaaaacaggaagcgaaaaagtgaaaacagcgagtatatacaactgttttgagaagttttgtttcaaagaaatgggatgatagctggtggggaaatggatcaaagaacgtgtttttaaaatgggagatgaagcatgtgtaaagaagcaggttgatgtgaatgatccagtagggagcataaaactaatgatgtaagagacagaaggaagcattattggagggatgtcctggaatagacaagaggaggtggaatctagtacctaagtggagaaggagatgtcagctttaggagcatggcaagttcactagtggtaactggcaggaagtcaaagtgtgaggtgtatatgctagtaaacaggtagaagtgatagtgagatttatgaaatcgtcttctgattgcttcattgttctcagtgaaatagaaagcaagatgatcaaatgagtgtgaggatggggcaacaggcagtgggagtctgaggacagagaagaaggtatgaaatagttgtctagagagaagagtgactagactgtgacctaaagtattgtcagacaatgttaaagtcatgaattggaaatgaggcccatcagcatggctatgaatttttctccagccgcattcaacttacagctgcagtgtgaataagcagagttggatttagacctgaaacaagaagggcaagagaataattataataattgatcttagagtttaagctggaggacggaagacatacaggatgaggtcagtgaaaaggtggtctgatcaatgaattggaagattcagggtactgaaggtctcctggggtcgagtcctagggagaataagctagagggctgagagacagtggtttgagaatgacctgcaagggattagtcagaatcccattcatgaatccaaggtggtctctaatgaggtagacagaggatagggtaaggtcattgcaggggaggaggtcaatgagccaacaggccaggatgggaaggatagtctatgtgtatattgaaatcactgagagataagacaagagagaagtgagaatgaggcaggagctaaaaaacatgagaaatgagagggaatgacatgacagtagcaacgttttagggcaataggtggtccaaaccattgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaagatgtggagaaagagggagagggagaaaaaggaaagaaaaatgaaaaatgagtaagggaaggaagaacgatatggcttcttgggaagagtacaatttagccactaatctgcacatcacagaattgtaaagtgtttaaattctctgggaaacagaaaaacatgatgttttaaaagataaactcaatattagatgactgaaaagagcctgtgaattgtatagtcttgttttccttggactcctcaaatattctttttcagttcttgttttgaaagggatccctctctcttgacttaaattctttaaacaacattgtttatatagtgatttaacatacagaactatttttcttagaactaggccacccagtttagaaagctgagggcctgaatacaatatgttactttcgtaagattcaaaagaatgttggtaaacaagagagggagatgtacactttgctaatttcttctgtttcccatggaaagtttatcaaactgtttgtgaaggaaatggtcaaaaagaagttttaagtgattaaccaagtagctttacagctgcagtcgtctttattgtatataaatatagataagagaggagaaaaatatttgagttaccagggcatgggaaatgatttaccttggcaaagttaataaattatgatttaatcattttctactaatgtagcactcatagaaagaaaatatacattattgtgcctggtgaaactgtaaaaggctaaaaggtctatgtagagtcctggcctgatagactagccccagagtgtttcagccaggggtgagcagagccacaggcttgtgactggacctgtgtcctggctagtgtcaagcatccccaccagtgaatgcgatacaggagcaaaatgatgcaactgctgttacagtgtttatgttacacaaaaccaaaataccagtatttataccagactcttattttaaaagtgttcagaattcaggaaatacaacagtgaaactaagtaatacgttttaaatgcaaattttaaaatagatattataaaatgtttctaatatctaagtgttagacataatcactctagcctaatttagataaaaatttttaagtattagaaaagaaattgatactacagtaaatgaataagttggttaatcatggaaaattgaaaatgaaaaagagtgcattgatgatgtcatcattaccataagagtattttttggagcaaattttttccagctgctataaaagcttccagtttctacactggtggcagagaggtgaacagagttttgctctaattcctattattttcttgagttgtcattttaggataatctctctgtgattactttttttttttagaaataactttttatggatggcaaactgtagtttttgtttcaagtaaagcatttctggttttaactgtatcatctttaatttatcctgtttgaatatagattaggtacaactgtatcaacctaattaattactgtcccattcacattccactttattgaacggtctttgaagtaggagtaagatttatgtatgtgatagaaggtttagaagctgggtgtagtggctcatgcctgtgatgccagcactatggggggccaaagtgggagaatcacctgaggctggagtttgtgtccagcgtggacaaggtagtgagaccctgtgtgttaggtcattcttgaattgctataaaaaaatacttgagattgggtaatttataaagaaaaaagtgtaattggttcagcaggctttacaggaagcatagtgtggcatctgctcatcttctggggagacttaaggaagcttacaatcatggcggaaggcaaaggggcaacaggcacatggcaagaggaggagagagagggaggtgccacacacttaagtgaccagatcttgtgagaactcactcactgtcaagaggacaacatcaaggggatagtgctaaaccattcatgagaagctgcccccatgatccagtcatctcccaccaggctccacctcgaacactggggattacatttcaacatgagatttgagcagggacaaatatccaaccatatcaccgtgtctctacaaagaaatttaaaaatcagccaggcatggtgctgcatacctgtagtcctagctactcaggaggctgagatgggaggatcgcttgagcccaggagttggagcttccagtgagttatgattgccactggcactccagcttgggtgacatagtgacacaccctgtcgaaaaaaaagctttgggttgtccattgatattttctctttcctttggaggagtatagagttgctccttcattcttttcaaattttaatatagtgtataactctttgcatatgtttcaagatgataattcagcaccttttacagtactggataatcatagtaaaataaatataccagaatttcattattttaacatacaccatatactgaactgccagaatactgagagaagatattacaatcactagttgaaaccaggaagccagcttcagtcatcaaatccaaacaaacagtgagcacaggaagagcagtaagtgcctatttattgaccaccttttgtgtgtcagggaggtgatagatgtttagtggtgaatgaaacaggcatggatctgtgtccagaattggttccatctggtgggttcttggtctcactgacttcaagaatgaaacgacggaccctcgcgatgagtgttcttaaagatggtgtgtgcagagtttgttccttcagatgttcagaagggtccggagtttcttccttccggtgggttcgtggtctcgcttgatttcaggagtgaagccgcagaccttctcagtgagtgctacaggtcataaaggtagtgcggacccaaagagtgagcagcagcaagatgtgttgtgaagagtgaaagaacaaagcttccacagcgtggaaggcgacccaagcaggttgccgctgctggctctggcggtcagcttttattcctttatttggccccgcccacatcctgctgattggtgtgtttacaatcctctagctaggcagaaaagttttccaactccccacccgacccagaagcccagctggcttcacctctcagatcctgctcagggagcttagaatgaagaaggcagaagcaggagactagccaggaagggcggaagccaggcagacagtgctgcaaactcacatgtaaaaaacaaggtgggaggaaagggagaaggtccaaggtaattgcccaaaaagggatgccggtctggagatgggtggatgcatattatacagaaacaagtagaaatcttaatgccctttcaaaaatataagtataaatttaggtggtgagttgtttcaacaagatacatgatccttgtttggggtaggggacagtaaagctctcaaaagcattcttgggacagtggaggaaattaaaatagggactggatagtaaatgtttaaaagaattacatgaattttcttaggtgtgataaatggcattaaagtatagaaaacagcattcttattctcaggaaaggaattttagtatttagaagtcaagtgttaaggtatttccaacttaccttcacaaagttcaactacaatgccaaaaacaaacttatggggagagagggaggaaagaaaatatagcaaactttaactaggtggaattatgtagctatttgattgtactatgctttctatgtatgtaggaaaatttgtataataaaaagtagggggtcaaaagataagcatgtgtattagtccattttctcactgctgataaagacatagctgagactgggaaatttacaaaagaaagaggtttaatggacttacagttccacgtggctggggaggcctcacaatcttggtggaaggcaaggaggagcaagtcacatcttacatggatggcagcaggcaaagagagacagcttgtaaatggaaactcccatttttaaaaccatcagatcttatgagacttattcactatcacaagaatagcatgggaaagacccacccccatgattcagtgatctcccaccaggttccttccacaacacatgggaattatgggagcttacaagatgagatatgggtggggacacagagccaaaccatatcagcatcctactctccttttgacaatggatgaggcagctgaaaggaataccaaggagaaaggggaagaatgcagggtgtggcctattatgactttgggcaaacgcttaacctctttgagcctgagttttcttcctctgcttcacagataaatatctacatacaggggtgatatgaagattaattaaataagttgaaatgtagtggttaagagtggtaagtccaaatctcaaactgcacttagttactaaataaccttgggaaagttacttttgtgcccagtttccttatctgtaaaactgacataataatagtgcctacctcccagaattgttgtgaagcacagaattgttctaaagagcgaagcttagcatatattaagtatttgataaatattggctctcattatttttgctatctaggactcagcatcctgaaaatagagaataccccttcttttcacgtgcccattggacattcacaaaaattgagaatttattatgcccataaaaaaacctcaatatattgcaaaaagtagagtgtgagcagcatgttctgagaacagttctgtaattgctgacataagtaactctctaaatcaactcttgggtcaaaaaggaaataaataaattacagaacaccttcaaaataacaataatggaaacctcatatactagaacttatggtctgcaactaaaggactttttagtattacttgtgaatattgatacaaaaatactggataaaatatgagtaaacaagatccaccaacacactcaatcatttaccacaacccactggacatgcccatgccctttcaaaaatataagtatatgatccttgtttggggtaggggacaggaaaactctcaaaagcattcttgggacagtggaggaaattaaaatatggactggatagtaaatgtttttccaacaattttgttttagcaaattacatccttatcacaacaccctataaaccaggtactatcattggccctgttcaacagataagaaaactgaggtgcagaaatatatagatatagatatagctagataaagatagatagatagatagatatagatatctatctatctttttttttttttttttttttttttttttttttgagacggagtctccctctgttgcccatgctggagtgcagtggcgcgatctcggctcactgcaagctccgccgtccgggttcacgccattctcctgcctcagcctcccaagtagctggtactacaggctcccaccaccacgcctggctaatttttttgtattttttttagtacagacggggtttcaccgtgttagccaggatgttctcaatctcctgacctcgtgatccgcccgcctcagcctcccaaagtgctgggattacaggcatgagccaccgcacccggccgaggtgcagaaatgttaatttgcagatggacacataggaaatggcgaggcgaagaaatgaacccaggcaatctgagcctataaagctcttccttttaaactctacggggtactctctgagccattctcagctacaaaagagggttagtaattcttatctcttgtggtggacaaggtaagatacggagttgagtggggagaggcattgatgctatctttatctgtttctgtattgttgagttgttataatgagcatgtattattcatgtattttttcatcaagaaaatgttttttaggggcctataaaagtgcctggcacaaagaagctcccaataaaaacattattatgtctgaaaggaaattcagaatttccatttgacttaataggaattcatcagctccggaagctgggtgaagaaaagaaacaagatagggcaacagctagaggagaattcaggtgagaggtttctactttcaaatgagaagggcttatacatcctaaagtaaggggtgggaacagaaggagggagaaggaattgggagctgggggaagagtggtcctaaagcctccctagatgaatttaattatttgggggaaggttactagtgaccaattgttgacatatatataagccccatttcatacatgccatgaataataggcctccctggggtaacaaaaatttaaagatcattctggaaaatgagacaggaattaaaagaactctatggcttgctttctttatctacctggttctggcaatgtgagaataggttttctgaagaggagccaatagtttgtttttccacttgtgggttacaatggtaaaatgattgttggcaaaagaacatcttttcaagcagcttcccttggtgtaggtcagaggggcaacaagcagagttatttctgcagctgggaaaaaggttcagagctatcttcctagaatcggctcttgtttcagaatctaaaatagatttgaaatattgtgctatttgggaattggggcctattcatgctaagcacatctgtgggtagctgttgaaattcaaataaattcaaataaagtccaagtaatgctcatactacacttaccaatttcaaattttaaaaatacatatatacaatacctgcaccccatttggtatcactacctaagacacaatatggaaagccttgattttctgccagccatagctgctttgaacctgaaccacaacatttaattcctttgaaaatgccccttcctccctacctgaacttttcaactgagattcattttcaaaagtttaaatatgaactatagcaaatagttctatattttggttttgatcatttgacagactttagtagctgcaatgaggttgttggactacttaagtcataaagccaggattgaataaatgcattttccttctcgtcatctttctgatttcagtaaatacagtttacttaggtgtggtgattaaggaaacctggtcgatttatttatacactattccattccatattcaaggtgtcttttaaaaggcaaagtaagggaacttgcctttttaaatttaaccatgactttcttatagtgatctacccaatgtatggaaagaagtagaactggctgggtgcagtgactgacacctgtaatcccagcaagttgggaggctgagacaggaagatcacttgagcccaggagttcgaaaccagcctgggcaacatagtgagacccagtctctaccaaaaaaaaaaaaaaaaaaaaattagctgggaatggtggcatgcgtctggagtcccagctacttgggaggctgaggtgggaggatgcttgagcccaggaggttaaggctgcagtgagccgtgttggcagcactgcactccagcctggagcaagacccctttctcaaacaaacaattattttaaggttgtgagtttttcttttttttccttaatagttaaaaatttgaaaggcatttaagtgacatattcatgtcataacctgagagtttacaatgttataagtaggtaacacattaagcacattatatgaattatctcttaatttaaacctcataattacccaatgaagtttgtgtcatcatttccatcttacttataaatgtatccaaggcttacaaataagtaatttgtccaaggtcacacactcagccaggagtgaaactgtgcccattattcaaattattaactgttttgatttttattattatttgtagagacaggggctcactatgttgcccaggctagtcttgaattcttggccttaagcgattattccaggtcagcctcccaaagtgctgggattacaggcatgagccactgtgcccagcctgagctgttaactcttaatctaaacaatgccttttacatgagaaacagtaaacaagatggcaagggatggcaaagaggatactgaaatatgttaggagctacatacaagaaataaattcacagttaaaagatgaagacctttatctaaatccaggcaaactgcaaactttaaaaagaattatgataagaataaagcatcaggaaggagaaagacaaactgatgacactgatatcccagaataaggccccatagacaaaggtataaccatcatcacatatggttggtgactcccacagcgtgttcctcaccttccccagtgcctttgggaaatgtgagtgttctctgtaaaagttctggcatggtgaaagatcgtaactctaggaagctgaataacttaccatttggcactaatatccctgatttcttctgtttaacttttttgctctcatctctatgttgaaaaatgcaatagatgttaaaatcagtaataatgttcaataactagtacagctgttcccttgttccacctcaattttatttatagaaaagccattattccactattctatatcaataacaattttcatttgtttttctacgtgtataatatgaattatattaaataacaaattttccagtttccataataataattctaatgactatataacagtctgttgagttgatgcactgtaatttatactgggtattttgtttccagttttttgctattataaatatccttccaagaatttatttaggcatctaatttacttaaatttcttcatatgcaaatagtatgtttatgtcctctgaccatttatctcttgaggttttaatatttttgaagatttggataagtccttaatttgttatgtatactaacttcttccctgtttcctaattatgtttcccttcttgtgtgtttcaatcattgttagtttttttatgttaaaatcactttttcttgatgtttttaagctatttttttgtgtgatttccattgttgccataagcttttcaaaaatgctgtctaaagatttcacagatatttgatgcatatttctcctagtttgctaaaaattaaaggatatagttaactctttaatgcactatgatcttactctgctatgtaccataagtgctaatttaaattactttttgtttttgtgttttttagccagttatcctggcaattattaaaacataattagccagacatggtggcacacatctgtagtcccacctgtttgggaggctgaagtgggaagatcatttgagctcagtagacgaggctacagtgagccatgatcacacaactacactccagcctgggtgacaaagcgagatatgtctcaaaattttaaaaataaagataaaaaataaaaatgaatacaatgaataaaatgtaattactaacttattttttcctaattttatgatagtatatgttgaatttatttctacatgtcttacactgctttattcaattagtgtaataacttatactttaggttttaggatttcctggggaaattctggagactagagcagcatcataagtcacactttctttgttagtgtggaatttcaatatttaacaaacagtaaataacttcacttggtgaacattgtttttctgtataatatatatctaaatctgtttatcttgttttgtatagtccattaaagctttgtacttttctttacatatggcacatacaattctttatcattttctttataaatgtcatggtttgaaaccacgtttgcagagatgataaaagtgagagactgaggcaagatgcttcttgcctcacaggtggtgctccttgctcattccagggcataggccaagctcactatggaagaaatttagtttatagtttgactttgaaccaaggatgataatagtccctccctaagactgatcccctccttgtccgggactgaagccacctttgtaaaactaatgaaaggccacaagattagtattatgggaggagcctcaattctgctcaaatgtaggcatagtttctataatcccttactgctcagtactcatgtggccagaggtcacaagatttaagacttccccaattgcgcccatagataacatcactattgtagaacctacgattgggtttttgagatgttttttcacttttgttttctggcaactgactgaccatatccaaccagtgactcatgactcaaccagtgtgtcctgtggccccccacccaaaggaggactcagcacactgggatcattttccatacccctgtgatttcatcccaaatcaatcatcggcacccattccctatccctctgtgcaccaaattatccatacaaaccctagccccttatcagagagactgatttgagtgataaccccagtccttctgcttggcagccttgcattaattaaactctttaactgcaataccaggacctcagtaaagtggttttttctgtgtcccctccacccttttttgtggctatgttaaatgggatttcttctctttttgttaaactagtggttaccacaataaagaaatcccctaattatagtgaattcactataaacctagtcactttgataaactcacataggctaataagcaaatttcttaggatttttagacatgcattgctttctgcaaataatcatagttttctctcaccccttaatgtatcattctgttgtcacgaagtgaatgcagttgccattattcctgtattagagtgctaggctggaaaggcaagaaacatacatgttactttcagttcctcaactgaggaagccattgatgaagcaccttcttttcatggatcaagcaccatgctaaacacttcatatcgaccatcttgcccaaggctgagaacaagcctaccaagtatacaattattaaatatcagtgttgaggaaactgaagtttagcagatgcaggctgcccatgttaggccccaagaagcaataaaaaatggaacactgaggggcctaactatgggggtctgtgaatgaaaggctgtgagtctgtgtctctgggctcctgtgactggcaggtttatctctacccaggagctgcattgaccatgaactttggccagtgatctatgaggaactagggagggatctcagagctgaatccgctcgcctgcatctgtgtcttgtgcatatgcttcacacttcctgtttctaggtcatagtaagtctaatgtgaaagtaatcctgaaggtagtctatgttcttgttttcactgctctccaacccatcagccctttgaggttaatttatctcagatcttagaaatagcaaacgatggagtaagtggcttccttcacgaccagtggtctttccattgtaccaatgatgtcctcatccaaatgtaagtcagataagatgatccaattttgacaggctgactgttcctgaatatgcattatacaaattctcacagaggctatactgtccacatccttgagttgcttatattgctttgcacataacaagtattcaataaatatttgttgatgcagaatgaatgaatgaatgaggcaaagacaacagtcttaatgcttttcctacaagagagactttcaatgatagaatacaaactcatgtggtatctcctaaaaatctcaccatttcacatttcaaatgtggaagcttctataaagactgtatttgtcatgagccttttcacaagaagatgtttagtaccaggtcagcttgttttcatcttgttttcaaagaattggggttaggaaagcaggaaactaggaaggatcaaggtgggaacagtggtaggcaggcttttctctgacaaagttgtttgggttatttttatctttctgcttctgttacagcaacaatatgagaaaactgactgttcaaatttaataaatagagtctgtccaaacccaattttgaacaaatgacaaactatggtgcacatgcattaacatttctgtttgggtatgcaatgggaaactaagtcttatgttctcgtctgtaatttaaacatacaaagttttaaatgttccattagaagatatactacaatactagtacattaattgagtgttctttgttatgccaaaaaattccaaaggaagttacacagcccctagaaggcatagaatctgtagattttgtaattatggtttttaaacttaaaatctcattgaagtcattagttaacatttctaaactttttgtttgtttttgttttagacagattctggctctgttgccaggctggagtgcagtgggacagtctcacctcactacaacctctgcctcctggattcaagcaattctcctgcctcagcctcccgattagctaagattacaggtgcccaccactacgcccatctaattttttatatttttagtagagatggcatttcaccatgtttgccaggctggtcgtgaactcctgacctcaggtgattcacctgcctcgacctgccagtgttgggattacaggcatgagccctcgcacctggccacatttctaaacttttatgcctgaataattctgaacagatattccaataaccttcctgccctccacctcatcccagccaaagccgggagagagggaagacctatactaccaatagttacaaacaattatttttggaattaaaaacaggaatttgcaccatgaacaagtgtctcgttttgtcttctgagcttctcaaaaaccaccattatattgagactataaaattgttctttaggctgggcaagatggcttatgcctgttgtattagtctgttttcacaccgctgataaagacatacctgagactgagcaatttacaaaagaaagaggtttataatggacttacagtttcacgtggctggggaagcctcataattatggtggaaggcaaggaggagcagtcacatcttacatggatggcagcaggcaagaaaagagagcttgtgcagtaaaactcccccttataataaccatcagatctcgtgagacttaccattgcaagaacagggcaggaaagacctgcccctataattcaatcacctcccaccaggttcctcctatgacacatgagagttgtggagatgagatttggtaggggacacagccaaaccatatcaactgtaatcccagcactttgggaggctgaggtgggaggattgcttgagcccagaggtttaagaccagcctgggcaacatagtgagcccatttctacaaaataaaataaaaaattaaccaggtacggtggtgcacacctgtggtcccagctagtgggaggatcacttgagcctgaaaggccaaggctgcagtgagccatggtcacaccactgccctcaggctgggtgacagagcaagactccatctcaaaaaaaaaaaaaaaaaaaaaaaaaaaagttctctgaaactaaaagaaaaatctagggaaattaaacattttttattgcaaatcacttaaccttagaatgtcaaagattttccctaagtttttatataaaaagaagcatgggagagagccatagggaatcaaaatttatgagccacaatatttgcaagaagagaaaacattacatcagccatgcacggtttctccaacatggatacaaagcagaatgatgtaatagcagctgcagttttgtgctaccacattaaacagtggtgcttttgatatcatttaactaaaccaaaatatgcagttcaacctcacatagctcaaaatactcagttcaacctgagatggtcctgaattaactagaccatgtttcaggcttctgaatattatttttaagttctgtgtaaggtaaggtataaaagaagaaaaaaaacctccttgcctcaataactttggttttaataaatgcaccaataaatttatttgaaccctgagttaaaatgattcagctctagtggatgaccaaattgaggctgcttttctttatttattcaagttagatttcatgtaaacccttaaattgtatgaattcaactatcatttctaaagcagccagactaatatgaacctaaatctgagtatacttttccagaaacagctgactatttaggtctcgttatctgtcctgtatctcactatcttcttcccaaccacaggaaactgaggattggctactgactatttgaaattggctatttcatagaggtaaaaatctcatcagtatgctggcaacagtctttaattttgaaagaggaatagtcccacttgactatttctagcttccagtattaggtcaggagagaaaacatttctttagaaccttttccataaaatcagggaataatttaggaatggggaaatcttctagtgttttatttcagctctcctagggatgtgcttcccaaggctttgacagggagaaactgatagctatcagtgtgaatcagctttgtgtctaacaatttcctttctaaggaacatcaagcatagagaaatgattaagcatatttatataatctaacatattaagtgaattacatttaggtgaaattggaaagtcagcacgtattgctttataatgaacatccaagccctgcttgatttgcctaatggactatttgataagggcaaaatacattctgatttaatggaatttctaattagttaatatttagtcaaagtgcaacattaagcgtatccctaattatatgtatgataggagtttacaaagcaattggtatgggttttatatttatatttatatgtcatatatctttttctgaaaaaaagttgaaactagaacttaaatagcttacatgtttatcctttctatccttgttaggaaaaattcctttaaagagattacaattattactgtaccccgataatcattattatccttgtgcttaattttcattcctctaacctatcctttaccttgagtttttatcccaaaatacaacttcatccatgtctttacagaaaaagtaaaagtccttagcaagctgtgcaagacccttcccctctggccattgtcccaatagcatattttagttaataaaagtctctcactcaaaatgtctggtgtctccatgttgttagtgtaggtatttcagacagcattctcctttgttaaacatcctacatacattagtctaatagttgtcaatgttataacacttatttacacactgggggaaaaattacccttgcattaccatgatggagttactaaacccactgagaagactcaataccatgggtagaatcttcattagtgtttaactctggatgtcattacctcccagctagagacattgtcaataaaatttcagcatttattgtaatgactttgactttgatcatgaaaaccacatttcatctttttctttgggttcagattgttctttcacacacacacacacacacacacacacacacacacacacacaccacacacaagaaaaattgtttttttcctttagggactttctcaaaccctttcataatcttttgttaattttaaattgatatttactggagaaatttgaaaataattaaaaaaggaaagaatgaaagccattcttatttcacggggtaaccactattatccctttgatgcacatttcccaaatattttcctgtccatatgttattttctcacaaaagtggggtcatccgctacatcctgttttgcaacttgctttttaaaaaagcataataccatattacaatcatctttatatattagtaaaaattcatcttcataaatttaatggctattatttctatttatggaaataacatataaaaaatcctaattattagacatttaaattgcttgaaacactttcctgttacgtacaatgctgtaatgaccattcttgaggcaaaatctttacctacatccttgattattaggatagaattttaggagcaggatcgctgaatcaaagtgcatgctcattttatttgtttacctatttaataaggcaacacaggcaagatgtacaaaaattcagaaggaccaatgggagattcagtgacaaataactctccctccttccttttccctcctaggagacagctacttttaatagtttccatttatttttccagagatatttaatgcatttatataaacacacacaaatcctttaatatgcctattaagaaattagtaaaatgggccgggtgcagtgactcacatctgcaatcccagcactttgggaggttgaggcgggtggatcatgaggtcaggagttcgagaccagcctgaccaacatggtgaaaccccgtctctactaaaaatacaaaaattagccaggtgtggtggcatgcgcctgtaatcccagctactcaggaggctgaggcaggagaatctgttgtacttgggaggcggaggttgcagtgagccacagtcgtgctactgcaccccagcctgggcgatagagagagactccgtcttaaaaaaaaaaatgatttcaataatgaaaattgttttataatttcatgtgctagataatcataggcacaaagctttctacaattaggcaacattcattatttcagttctatattatttcttaatttatattttaccttacctttatgtaataatatattacttgtcatttaccatgatatttttatcttcattgaatactttaaaaacattttattataggaagtttcaaatgtacccaaaaagagaatgcgataaatccccaagtctccaactactatgcacattttaattaattaatttatttatttatgtatttatttatgacggagtctcgctctgtcacccaggctggactccagtggctcactcggctcactgcaagctctgcctcccaggttcatgccattctcccgcctcagcctcctgagtagctgggactacaggcgcccgccaccatgccgagctaatttttttgtgtttttagtagagacagggtttcaccgtgttagccaggatggtctcaatctcctgacctcgtgatccgcccgcctcggactcccaaattgctgggattacaggcgtcagccaccgcacctagcccattttaagtctttcaataaacaatgccaggtttttctctatgaaaggttttttagtgagacttaccctatcttcattttgttgagttgaattttatagctgctgaagccagggttacatcttttagcaagaataaattggtggttggaatagaaaaagtatagtaacttttgttgcactgtgacaatagattttatctggcatggtaatgccaatcaacttggcatcatttcctggctcagcgagttggaataattatgagaatccattcagagtctgtggggaaaactgctaggattgattagcaatgtctaccattggaaaagtagagaattgttggcttttatgacatagacagtttgccgattctgctttagcttacatgcataacagcatacttttttttaaaccattcttttgcttagtagccataaaaatcaatttggcttatttaaaagtttcataatgaaacatacctatttacctataggtttcttttgccagatattatattaacaacttttcttaaaaataattttattttttgaaaggaactaaataatgtcagtatatagatgctgctgtactatcattaaggaagcatgtgctgaggttgtgttctcagaaacaaggaagaatgacatttgtccagtcatggagctctgtggctccatgcagggccatgaatttgttgatgtctgtgatgtacagtcatggaacagagagaagctaactgacccatgataagttaaacctcaaatcttaccacttttaatgccacagtaaaattttctaaactggtcaaccacaacaaaagtatatttaaaaactaatatgaagtatatcaagaatttaagaactgctgtttcatgaacctatggaatggcagatctgaaagtcatcgtggagatcgtttagaccaggagcttgcaaacgatagccagtgggccatatccagcccactgcttgtttttgtaaatcaagttgtactggaatactgccaggcttatttgtttatgtattatctgtggctgcttgtgcactatagtgacccagttgagtaaatgcaacaaggctatatggaccacaagcctaccacatataccgaggctatatgaaccacaatgcctaacacatttactatctggccttttattgaaaaagtttgccaactcccgattttaaccaacttttcattttagaattatggaaattagaaatcacagaggttgtgtaacttgtttgggataattctaccacttgagaaaatagccaacagaattcccagaacccccagtggcaggatccagagctgcagtctcaagagctgcagtctctatctgaaagagagcattttcacgtctctggaagccctaccctaccttgtcagccatgctgccactccctccctccccacttcacacacttaatgcaataaaggcaaaatgaatacatggatgaaaactctcctgtattcatagaatatttctcacattccttcatcattccaagtattatacggaattgtaatcatttgcctttcccactagaacatgagtgcactggggacagggacaatgccatatttgtctttgtatcccagatgcttagcacagattacagaataggtatctattacctgtttgttaaatgctttggatttgctatcttatcttcttccatgcccattttaagataaacttcaactacagggaagataaatgcaagttgtggtttgtaattttcatcattcctgaccaagacccaccactgagacccaacaataggagatatccagaaccaaacaccatgataggaaagttacaaatctgtttttttcattgcacctactaaggaatggcccaaagcctccaaggcaatcttgacctgcatccctggcaaacagatgagaacctgatgtaagtcagggataataagagtgaagaagagagagatatgaaagattattaaaatcaagaggacatcatggttgattgactgtccagggggtggttgaaagtctgtgactgcccagattctgccaagtttcagaatgcaggaggaagagcacattgggtaagggaggtgtgggtgggaagggggcatggaggtagaggcagataggatacaagcggggaggttcagtagtcaatggtatatgaagctgcagctttcatgataaacatgggttcagatgaagtcattcagagagtaaatcaagattaagagaacacaaaattaagcctagagatcaccaaaaggattgaacaaagtaaaaaggaactcccacttagaaggatcacctagagacacaggagggaggcaaaagggtagtgtcccaaaagccgtgggcagagaaaaggaaaaatgtcaagtaagatggcaaaacaatatatgcctttcatttagcaacttggtggtctgtgacaaccttcctgagagccgttttagtggaggagttgtcttggaagcctgattcaatgggtagaagagtaagtgtgaacttgggaagagacattgagtatattttactcttaagaaacttaatcgataggaagaaagagaaatgagatggtaactggaagataggtttgtattccactgagtgggtagcatcattgatttgtgaattctttgaagagaatctaccaggtgtcagaatcatagagggaaggtatataaaagccaggtgggaaaggaaacatcaccaagaagaggaggaatttatctctatgaggctaggtcttttcacttataaatggaaataataatagcttcctcagagagaagttggaggtttaaacgaaataacataatttaaaacattttgaaaacagcaaagcactattcaaaaccagattattctatatattatcaactccagttgattaccttgactcaatatctgattagtctcaatcttagagtccaattatgattaactttgtcattgcagctcagaagtcagggatcaatttccttttcctgacagtgggatatattctgatgccttggatgccagataattcttatttacttcagttatcaaattaagtaccatgtttaaagcaaatcagtggtgctgccacagtgcacatgcatagtcaatggatgttataggagatacagatgtctctgtcagtaggctaaggggtgcaagttactagcctacatgatgatacccaggacaggtaaagatgagatgatgttggtggctagacaagatttcagtcgagtaagacttcccatctccttagaattatagtagcaaagatatcatgtggcagaaatcaccagagctagactctggtgaaacccttatgctcaattttttgtgatgtggaagttccttctaggctctggtattacgaagtaaaattaaaaagccaaaatcaaaagcttactcttgtgaatcagagtgttacaactcctggtgagagaactaggaaggagatcttgattatgggaccattttctaaggagttaaatacagattgtagcaacatagatcctagattatgaaaaatgctttactaagttttgctttttttccattacacaaattcaatttgtttgaacaagattataaaaatagtaattataccctatcagctaattatttttttagaatgaatgagttataacagaagcaagcaacacagttagcaagcatcattactgtttattttcattttttcatgtatacacttacttatttatatcctatgttcttccacaaaggagccaaagtgactgttgctatttatttcatatgttgttattcataattcattacccagaagacaccagttctcttggtagtgaaatatatgttaatttaagtatttttttgcctcaaacatctcaaatagtaaattaaaatctcttatgaaataacagaagaatatacaagttctccaagtccttcaaagaataaaaatattatttacactcctgtatctgttagggttagagattggggactttaaataaaataactaaaataacaaatgaccaccaaatcccaccgtcacggacgatgggaaactaaaatcagctttaacattttcagacaatttccaacctctcatccactcctcttttgtgtcctcaccctgctccacattttgctttactctgccctgctctaagcagatggcccttgtggtcatatgtcaagatcctaaaactatttctgacctggaacaaagttctgcctgatttgatcttagttcaggtcacatgtttttctccatctattcctatgaatgtttaagaaaacttattcacttccttattaatagaacaaaaacatttgtttttgttctattgcttgctcttacatggttagccaactacaatgaaccactcactcctggggaaatcactagaaacaaagatttaatggataaaaacaccagactagtgacaattttttctgatggaaattgtttggaagttttttttttcttaaatatgaaagtagagctgtgtgacttataattaaatgctgattatcctctgtatggacatattcacaggtagctgtgtgtatacttgtatatgcacaggaaaggtgtgaaagaatacaccttcaaagagtggccatatctaagagtggggctgggagatgagaaaggagagctttcacttcctgcttcctgtatatcctgtttgaagttttacaatgatcaaatattattgttttaattaataatgtgaagaatgaaaatatttctaacattcacaaattaaagatgatagcatggttgatttgaaattttttatactttgcacagtggtgttttcaattcagtgatttatgacacattttgggctttatcctaatgcacgaatgattgaaaataaaaagatgaaacttaccctaattatcatacatatacaattcctgttagatatgaatatcttgcctcaagatttttattaaagagttctaatttagtcctatctctgtgactaggattataaccttttaatattgttaccaagatcttatacaaattactcattgaacaagcaattcattgaacaccttgtcaacccctgggctgagcattgagggcagagatgggtagacgtgagccccttcagttgtatgagctagctttcattgcatgctttccatgccccaggactctgtgtagtgctttacatatattaactcctttcatcttcacaacactcctgtaaggtataaatattattaaacccattttactcagattaagaccctgagacagatttagaatcccagaggtctagctctgactcaaaagcccatggttttaaaccgtgacttcgtagtgccttctggatcataaagtagatgtaatatagtaggagttttacaagtaaatatttaagtatattttaacatttgtaattatttaacaattggaacaactcgaatttccaacaataggaagttgattaaatacaacggagtctacccatacaatggaagacttaagaagcatttgaaatgatgatgtagaatgtagacactgatctattaacattaaaaaactatctttggcctggtgcactggctcacgcctgtaatcccagcactttgggaggccaaggcgagtggatcacctgaagtcaggagttcaagaccagccaggccaacatggagaaaccccgtctctactaaaaatacaaatattagctgggcatcgtggcacctgtaatcccagctactctggaggctgaggcaggagaatcacttgaacccaggaggcggaggtttcagtgagccgagatcgtgccactgcactccagccttagtgacaactctctttatattaagtggaaaagattataacagttcttataatatgatttaaactttgtaaaaaaaaatcatataattaaaagccaaagccagactcataaaaagcatccacatgcttgtaggccaaagcaggctccataaacgattcaggtcagaatactgggggatgcatcactgatcactgcactttctcccatggagcctggacaaagcttcactcgtctcctcaacatacagccccaggcatccactaccagtctatctgaggtggccctcaagagaatcctctttatcttttgagcatttgctaccctcaattccactgctagaatctattcatctagtatttcctcttggtctcattcttatcccttatttcattctcctgtgtgtctccacgtgactcctttgtgtacacttttcttgtgactcagttttaccctggatcctggtttgctacttctattattgctctctttcacatcatcacctttttttttatcccatcattcccataggcacacaaatatgctcttgtatctacaattgttttttaaaagatgtcctctagagctacatcatctccagccctttatagcacatctccttgataaagctatgttgactgtttcttctttctcacccacctatttttctcttcattccctcccagcaggctttgctttctacctctccattgtaaccaggatcaactagtgtccttgactttgaacttgccaaatccagtgatcagttctttggcctgtgttacttaaacattcagcaacccatgagactgttgagacccccttcttgaaataccttctttgctgagcatcttcgtttcttcaggctgctgtaacagaacaccatagactgggtaatttataaacaacataaatttactgctcacaggtctggaggctgggaagttcacgatcaaggcactagcagattcagcgtctggtgacagctctgctctgcttcaaagattttgccttccagctgtgccctcatatggtggaaggggctgacaagctcccttgggccctcttttataagggtactggtccctttggaatcctcatgagctaatcatctcacaaaggccctatctcttaataacaacacattaggaattaggtttcaacatacaaattttgggaggacacaaacattcagaccacagcactgagtttctaggataccacggtctcctggctttccttctgcctcacttgctccatcttctcagcctattctgtgggatgctcctcttgctgaccacttctcttctgtttccatttattcccaggtattgccatctagccctgtggcattaaatatcatctgtaatcagttcccaatttataattccagtttcaatctctctcctaaattctgttgttaacgtaggtgtctaaaaagcatctcatgcttactgtgtccaaaacagaacactcaatttccaccctgtggctaagactgctagctgtcctccagtaatcatcctctccttctattgtaatacatgtgtttttactgggcacacagccactcagaataaagcctacattgacaacatctcagtctcttttgtagctgagttctggccaatgagatgtaatcagaagtattgtgtggcagctgctagaaaacctttttaacatactgcaaacatatataatcttcctcctctttgccttcatctatcctgctgtctggaacacagatgtgatggttggaactttagcatccatcttgggttatgagaatggaggacaacatcctagaaatcatggagtggtgagttggaaaggtctctgaaggtatggagttgtcatacctgtcctggactgcccaccttcaggcttcctttatatgataaaggaatacagatgcttcttgacttatgatagggttatgtaccaataaacccattgtaagttgaaaatactgtaagtgagaaatgcatttaatacacctaacctactgaacaccatagcttagcctagcctaccttaaatgtgctcagggccaggcgcagtggcctttgggaggccaagatgggaggatttcttgagcccaggcattcaagaccaaccctatagctgggctaaactatttggcaatgcagtacattgtagagtatccactgtttaccctcgtgatctgggagctgtggtttgctgctgttgcccaacattgtgagagaatatcaatgcatattgctagcctggaaaaagatcaaaattcaacatttgaagtaagatttctactaaatgtttatcatgttagcaccaccagaaagtctaaaaaatgtgagttgaaccattacaaagagtccccccatcagggactctctgtaaactaccttcttcaagccactattactgtgcttcaaagctgaatctaaccctaactaatagtcatctatgtctatcagagaacaatcctcctttcacataccaggcaactgaaaatataaaattggtagaaaagatgatccgtttttacactactttgctcaacagataacttttctagaatataattgtactgattaaggatttatacttccattttctcaggttttaaatgaattctaataaaaatctttatgctgttttgattatactcctctctaaatggatttgtcctcatctgacattttgtgctggtttgaaaactttcaaagacaggcctaaaacaaaatacagccttctcaatacataaaatcatatccaaatgtgagttttctcaggctataatatctagaattttttaactttgaaatgcaatgtttattcaatatatggtaaaaagctccgtaagtatttgtgaatgaatgacttagtaaagagtatactatcacataattatttaactacataaaattaccctggtgatttaaaaacatgttccccaattttttgatactcttttcactaaaggtgagtgcatttgtgctgctataacaaaatatcttagactgggtaatgtatacagaaacttatttcccacagttctggaggcttggatgtccaagatcaaagtgctggcaagttcagtgtctgataatggcctgatctcttcttccaaggtggcaccttgaacaccatttcctccagagggggctaactctatgtcctcatagcagaagaggtggaaggaatggaaggaacagacttacccattcaagccctttttataagtggctaatcccatgcataagggccccccctcatgacctaatcacctcctaaatgccttacttcttaatactgtcacactggcaattaaattttaccatatgaaatttgggggatacattcagaccacagtaggtgagatctaatttccttccccttgaacatgggccagccttagtgactgacttcaaactcatagaatgtgttagaggtgacactgagtgtcttccaagactaggttagagcaggcagtacagtttctgcctggctctactggacatacctttggatccctgtgacaacacacacataaaatgtctggctactttgaagccgccatgctgaagaagtcatgtagggatagagggagacgactgaggagccagagctgttgcagaacccagctgactgagttttcccagcatcatctgccagacttgtaagtgattccagttattccagtcctcagcctcagagctgctcttggcaagtactgcaaagatgaggtttccctgttgagccctgaccaaattgcagacttgtaagctggctaaacagtgtttgttatttctaggtgtgagggtagtttgaacagcacccacagtattgggaacattccctcatcagcacgttgactctctatgctgcttgcttgattgtcttggagaacataatgaccctttcagtcattccctttgggttaattccctctgtggaaaaggggtattcttgcacttgcctgccactcctgtagccacaatttagagagggctttgttcccttcacctttcctctatccagggaaaatatcagacctgttgccttccaaaatggaaacaaaatcacctgtttcaaagcaagctgccttaagatgtggtctgtaaagatactacaattaagtgataagctttcccttttctttaccctagaaacagaaacagactgtgtttcagcataatgcaggtgaccaaggcatatcctccatataggaacagagcaactaaaaagaaaactatagcctcattaacttgtctgaggtagtgatttgttaagtgaaaagcagtgggtggtgtagtttttaaaaaggtgggccatattaccatttcttcagtgcttcctggggaaaaggatactatcattatgtatattctctaggccaggtttcacctaggctagagaaagaacaatctaatgtaattctgtctcattagtgcattagtgcatttccctcaaaaggaaaattattttataaatggctgatatacttgcctactataaatgatgcatggtattctagtttataaattgatctcctaggaaatcaggtgtttgttcccctaaacttgatcattccagagagcttttaggatcaattccttgaccagagaagagctttggcaactccaccgatgtaacggtgccttgtaggatcccacagaaagctgctaactagtttttttctttctgtgatgtacatttagctgtagcaggaaatagtgtgtaattagaagaggctcccaaaggttgaggccttatctggatgattgccaagtccaaactgcactttgtagacccaatctcagggagtccagtttcttccacagcaggacccacctactggctttagtttcatggttgtaacttctgcgaccccaagcttttaattctattcaaagcctcatcatctaaaagtcatttggaaaactaaagaatgacagctatcaactatatataagtagctttcaattcaaaagagggaggtgtaatataatgaagttaaattacattttgattctggttgctagatattctttgatcattaatggtgtcagcaaaattgagcacaccttaaagtcagacaacctcttccatgaaatgtttctctcctctccctttcagcctcacatccttccttcttctactttgtcacctcccactagataagcaacttggatatattgatgacgtcctcttatttgccaaaaattcaccaagctgttaataacttagatttatttatgaaaactacagcagatttaagtcaaccaacaggcccaagctctttaaattttttgttactagggtgacaattctacacccaattttagttttcaaaatctaggcagaaacacctttattgggatttagcaatgactttgttttataacctgcagagattattaggaagatacatatttcttcctcaccttctattttgttctatatttttgttaaaagttggcatatgagtacaaaaaggaaaacgttttttatgatcatctctgtctacataacagactgaaatttgtgagcatttaacacatttgtgccgaaaaatattgaaattataaaagtaccatttacaggcagccacctaccaactaaaacattactatggcattcttaccttccatcatgagcctccctatgaactgagtcacataggagaatctaaaaaaaaaatcctgggaggttcaaaaggtagccatttccctaacaatgagacatgtccataaagaagggcttcattatttttgattctcgtcaaatatttcaaggcattccgagagcccccatcttcagggttaaccacatgtagtatgctcaatacagccggtgtctaatacacagccaaacagtcgtctttccattaaaatgtgatttttgcttctgcttttccatctagcacatctgttcttctagcggttcttgtgtcgttagccgcctttccatcccaccttggcgctattcttttaattcaattgtgcgcaaattgcatcaggctgtcagggcttcgctttatgaatttccctttgaggacttgcacattcctctcggcacagaggtcggagccggtgggtgcccggctgccgccgccccgcgatcaatggcacctgaagcttccccgggcgaggccgtggctgcctggcttggtcccggagtccacggccacagagactggtgccttgaagacgtggtttttataaccatagaacgttgcatgccttattttaatggaaaaggtatctaacgaagtcggccgtaaagcaaaactccttaaataaatctgttcccccacccctaccatttccattataaaatcaaacaaacagtatcagcaagccgggaaaatacagagctttttatgtttgcacctcactttgttcccagcaggatttaaagtgatttgtaagcgtatgtaaaacaagagcatgtacatttaaaagtgaaaagggattaaaaactagggtggggacataaaatagagccaggacaaggcttaagtgatgcctaaaataacaacctctgctatgagtgggccacaatttggcactagattatctagtagttctctatcggctaatggcatcccccaaccccaactcaatttgtttatgagcatttttggtgggagatggagagatcagggtgagggtgaaaacgcaggcgtgtctggccaactcatttttcatttggcttcatgtaggagtcgattttaacataactggaagagagaacatcctggactgtgcatccttaaagcaatcttcctcaaatattgctcttctgagacaaaggcgctcgtaaatattggaaggcattgaattcaaaatctaggcaggcttgccttgccaagaacagaaccgtaaagatgtatacagctgctctctctcctctccttcacaggcagacagctagaaagatgatctattcttgctgtcttagattcttaacttccccctcactctaaaaccatgcaaatctagcttccacccccaccacttcactgaagctgagcttgctgaggtccccaaagcacttttcagttattttacttgggtcctgacagcatttggacactgactgctcccttcttaaaatacctttgccttgggttttcctaacagcacacgttggtggctatcatctccctcttctctggtcatgccttctacatgtcctctgttgccttcttctgcacctgacccttcaatgttggttgggatgctgttctagtgctgagaaccctgtaccagaaagggtccacagaagtgtggccaccatacagaccggcaaaaaaaatctaattcctctgaatcccagagtgaagaatttcatgaagctcttgttaactgaataatggctgcagtagacgtggtatattggcttggtcgacctctattccaaactccttctggggtctttcacgtactgcagacactggagagctaggagctacatttcctgactgcctcgcagcaagagtttcaaatgtgatttagtcattattaatcagaggtattcctgtgaaatttgaatttgggactgagttcagtggagaaagaggcagcagtgcctgaggcatccatttagctggtgtgaagatctagcccatgtggctcgggggccaacaattctggtggtgccttcctgatacctggactgatagttagggtagtatattcataaatacagtatttttcctggcagtcagattcccctaataggcctatcaggaaaaattgtccaaggcttgaaattgggtcatagagatcgggagtgtctttcaggaaaattctgatatggtctggtagaaactttaggaattttctaattctataggggtatgcactggtgacttcctattaactaaactattttacaactctgtaaggtagaaatttatttgcagcaaactatagaaatccagatagttttgttttttactttttaattttatttgaatgtagcagaaacaggatctcattctgttgtccaggctggtctcaaactcctgagctcaagcaatcctcctgcctcggactcccaaagtgctggaattaccagcatgaccagccacaaataattcttatccatagcaaaacaaatcttttttttttggtagatataaaattgattttagccctgaagaaaagataattccaaacattattttttattgccctaaagctacattgtctaatatgaaagctactagctatgtagttattgaactcttataatgtggcaagtttgaattgagatgtcttataggtataaaatatacaccagatttcaaagactcgatatgaaaaagtatgtaaaaagatctcattgattttattatattgataacatcttgaaataattatatcttggatagagtgggttaaataagatattattaaaattaattttaactatttttacttcttaaaatgtgactcttagaaaatttaaattacagatgaggcttgcattatggttctgtcagacagtgctgtcctgtagaattttagccagttttgcatctattaaccagttgattgaaacatttctgattgtgtgtgtatatatgtatacacacacacacacacacacacacacacacacacacacacgtgtatgtatctctgaattctcctttgaactggacttaacatcttacagattccctcattaattaatgtattaaataaaatatttgtgacatgtcattttatacttgcatgagaatcacagttctaacatttatactttagcagtcaattctgcagagttgctccaacaggcccaatctagatttgttattccagttcttccaattattttgtaagtacctaattccctgtattaaattccatcctaaaatggctaaggtggttttagttacctgctactgcaccctgactataccctgacattagcttaaaattgaacatttactattttccagatactgtgttaaacactttacagattattttatttaatcgtcaccgcaactctgtgagggaggcagtatactcctcattttacagatgaggcactgagagtttaagaaacttctccaagacaaccaggaagtagtagctggactcacacctaagcatactgactctaaagtctacttccatccattaccactgtgccagcacctattctgttccaccaaataaaacagaaagaagggcatatctgtcactagatatgtgttgacctagaagctgcggtgcggcaaggaagttacaggttatagtcatcccctcacttgttctgccttctctactcctaggacctttgattcaattagctggttctcagaatcctgggcatagctcaagcctgagtggctcttccagactctcacccaactgaggaggttggatgatgcgccattttccgctgcaagctgagaagcacctctgccaagaccaagaggtctcactggtggagatgcactagaagtatgtgactctgagggtcacagagcttgctaaacaggctgtctaccatctttggcaaaggcaggaaacaattacactgtaataatagttattaatggccagatgttgcactaagtgatttacatacattctctctaatcctttcaatagctcagtggggtgagtagcagtatcatccttttaaaaatgaggaatcttaggtcttaggttaattatggatgctctaggatttcctggataatcactgaactcactaatcaagggctacatatctgacaaatatttcagacattaaaacatttgataataaaggagtctatggtattatttgtccacatgtaactgaataaagaaacttgttaaagaaaggagaatggcaaaaatgttatatattatccttccattattaatgctagtttaaaagcttgaaattgacaggcaactcagtattttccaacatgcatcacattagcttttaattcattatctgtctttattttttactgtctcctttcttgctatggtcttcattttatactggcgctgaagagacatctgaaaggattatgccaccccactttagtcccagggaatagaactactatgaattattgatagtgttagctttctagtgctttaatttcacctctgtttcagacaaggatattagttaaatggaattttttatatcaccccaggagcttactacacaggaaatactgactgacttgaattattgaaaagacagtcctatgttgatttccatttctacataggatggattcttcatacattccactcccctatatttttgcttagtgttaggttaatagggcagttttcaaatggagtccctcagaacccgcgggattcctcagagatgcttgcagtacaactggagaagcaagagggctcggtgggatggtatctgcaggtagacatacacatgagtgcacacatatgcccccaaccattgccttgcttcagagaaaaacttcacttgtctaccgtaagtattaagcctttgtgcaagattatgttggaagaaaggtttcttctcttcacaaatcttgaggctgtgtatggtggctcactcctgtaattgcagctcttgggaggctgaggtgtgagaagtgcttaaggccaggagtttgagaccagcctgagcaacatagtgagaccccatctctacaaaaaattaaaaaaaaaaattagccaggtgtggtggcacacatttatagtcccagctactctggaggctgaggcgggcggatcccctgagcccaggaggttgaggccacagtgagtcatgatcacaccactgcatttcagcctgggtgacagagtaagatcctgtctcttaaaaaaaaaaagagtaaaatatcctgagttaatacaataaatacaatagatgtttgcacatctttgagatactaagaaaacatgtctaaggggttttatactatatagttgagtgtatacagctgtgcactggacttgacagaagctgatggcatgtcatatgactaggcttgcaggatggacttggccctcctgtggtattgtaagaattaccccgaattctgggtaaagccagttaccatgtatatttatgtaatgaataaactcacaagcgcaaaaaaatgcaataatattggggaatggcaccgataaatgaaccaattgcacaagtaaacttggttcacctgcttctattcgggtcattaggcccctgaatccataggcctccaatgttctttaagagaaggaatatagtcattgcttgtgttcttcagaagggactaccatgagtaaaatattttctgagtttctgtaataagagcaaatatttctctaacttgcaaagagtattttaaaatgtgagggttttgttttttgtgagttaatgagttaaaaagtagcattcagggttcctttctgtatgtggatggtataggtgcctagaaattgccctcctcccacgcatggaagctgtagacctgaagaaggtaggcagatgacaaaggctcattcattcagtatacatttatttcttcggggtcggggggtatttctttaagttttattttatttgtaattgacctatgattgtacatatttatgaatatgtatttattgagtacccactattaccaggcatcatgctaggtgttgggaatctaatagtaagacctatcctgccaccttcttttttgtgtgtgtgagacagagtatcactctgtcgcccaggctggagtgcagtggcgcgatctcggctcactgcaacctccgcctcccgggttcaagcaattctcgtacctcagcctcccacatagctggaattacaggcacccaccgccatgcctggctaatttttgtatttttagtagagacagagtttcaccatgttagccaggatggtctcgcattcctggcctcaagtgatctgccacttccacttcccaaagtgctcgaattacagcatgagccacagcacccagcctgatcctgccaccttcttagaatttgcattctgttgtggaggaggcatataataaacacatagacaatcacataaacatagcaattacaaaatgtgatcgttgacatcatgcatgcaacagagtaggggtggggcccttttcacataggggcagtcaaagaggaggccctagaacagcagaaagctaagtgcattttagaaggccacagctggcctctctgctggcttccaaagcaataaatgcgtggtgcttactgtatttgatggctaaatacatgccatctgtactcaagaattagaatgctgtggaaactctgaggggaccaatagttggtgacttcttgtataggaacaaaaaatatggcacagttaatttattacacaaatagatttttccttagttatttaacatttatcagcactgtgttttatttatttcttaacgcaaaggtgggctgagggataattaaaagtaatatacccaagatcattgtccttttccattccataaaaaaattgtctccaccactgtttatgatcctcatcaaacatataaaaaatgcatccataatgaaatctcctcttatattgttactttataactgttaaaggcaacatgatttttgtaaaggataaaatagactacaaaaattagtttcattttcaaaacctctacataagcatgtaaaatatattagagtgaagagggacacatggttatcaaataacctgacttctatcaacagaagtttccagtttacattattattctttcatttttactagatgaaccttcttttttgtttttataagcttatcagtggatcacccttcttaaatagaaatacctggaagatatatgcacacaaaactgattcagatttaccgcagaaatactagatttcaatgggacattcaagcaaatataattcatccatctacccatccatccattcaatatttattgagtaagctaaactaataggtaaaatatgctggaaccagagcagtgtattgtggttgtgttggctccttgggtgggtgaacacttttcctgtttttttttttcattcttttgcacacttactgtagaaattttctgaaaggcaagtagtcaaactgactggatagcctaagaaatttgaaattatctggccgagtgcagtggctcacacctgtaatcctaacactttaggaggccaaggtgggaggatcacttgagcccaggagtttaagaccagcctgggcaacatactgagactccatctccacacacaaaaaaatttttaattagccaggcatggtggctcattcctgtagtcccagatacttgagaggctgagatgggaggatagctgaagctcaggagttcgagattacagtgcactattattgtgccactgcattccaacctgggtgacaaagtgagacccccatctcaacaacaaaaaatgaacaaacaaaaaaattatccagtccagccaatgtgataaaatggactaacagaatgaatttggggaaaataattcaggaaaaatacatggagtggtttactggcaaccccaagaaaaagagaaactattatactactaaaggagttcagtaaggcatctgattacaatacaagaaattactagttttcctgtatcttgtttaaaaacataatgattaaaaagcatcttgttcaaaatagcaagaaaaatatgagtataaatttatcaagaaatatacaggacctgaattaaacaaactataaaattttagtgagaaacttaaagacttgagcaaaactggagaaaattttcactcttgaggacaagctgaaatgttagaattgccacttttctccaaattatttttagatttaaaaggggatgtgaaaggactggatgaaattatgctaaactctaatagaatgtatgacacaaacacggacatttaaaactagaagaataatgaggtggcggtatagggactaatggacattaaaatatattctaaaactataataattagaatagtttggtactggttttatattctaaaaccataataattagaatagtttggtactggtttagggattaagtaaatatatcaatggtgccaaatagaatgcctataaacagactcaggcatatgcacaaatttagtgtaacagttacatttggaatctgtagaaaaggataaattatttagtaaaagatgcaggaggaaatgtctattcaaaattaagacatctttttcatataaggcaatcacataattccagatttatgaaagatttaaaggataaagccatacttttatatgaagatggcatattttgaacgcatgcatttgcctctgctccctcctcaaccctacttaagtatcagtaaaaatgatttttaaaaacccttaaaaacacccacaaggacaaataacgggagataaagctacagcaataaaaccttggaaactagaaagcagatgagcgggtggtaatgcaaatttgattgtaagcattgcaggctaccaaagcagagaaatggtccagttaacacagtggaaatccctcaaggctcaggctactggaagtgggcatgaaggtggggctaaaaataaaagcactgattccaaatctgcttactaagcagttgtgccccatgtcacacaggagagcagctgccctgtctgctcaggcagaagccagagttcatttgttttgagacagtcttactcactctgtcgcctaggctggagtgcagtggtgtgatctcggctcattgcaacctctgcctcccaggttgaagcgattctcttgcctcagcctcctgagtagctggacttaacggtgcacaccaccatgcccagctactttttttattttttggcagagatggggtttcaccgtgttggccaggctggtcttgaactcctgacctcaactgatccacccacctcagcctcccaaagtgctgggattacaggtgtgagccactgcacccagccagagtttcacttttatagacacagttgaaaaaatgatgtagtgctgaagacagggattcagtgaaagttaatccctggaatgttgaggccttaaccttcttcccagatttttaaagcacacataaccagactcatagcttctaggcaggaaatagggtgtatcttccctggagaatatgaccagtccaaggaaaaagatatcaagataccaacgtcagaggctcccagatgcaatggtcaccctagaaaacctaagactggccgggcacggtggctcatgcctgtaatcccagcactttgggaggccgaggcgggcagatcacgaggtcaggagtttgagagcggcctgaccaacacagtgaaaccctatctctactaaaaatacaaaaattagctgggcatggtggcgcatgcctgtaatcccagttactcaggaggctgaggtgggagaattgcttgaacttgggaggcggagattgcagtgagcccagattgcgccgtggtactccagcctgggcgacagagcgagactctgtctcaaaaaaaaaaaaaaaaagaaaagaaaaaaaagaaaacctaagaccacagctcagcagtagggcaaaagagaaatccattgcagattggtggatggggaggctcacactccttcacccactccgggaaacatctgactgaattgttaaatctgccctctgaaatggattgttcctgctgaaaaaaactctggcccaggcattgatcccaggccccagtggtttggaccctgcttgcaggacaggcacctgaagagcacactgcattgcaggcaggtgtgtttgcaggtccctggccatctagactaactttaagggtcctcaatgctctttcacaattcctttaacatttgtcaactcctttagtgattattacaccttttcactttattcaatccctcaactcttcctccaccccacttattctcattaaattaccttacctccctcacactgagaaaatgaaagctatctcatgtgaatgcctctccctatccaaattgctctccaatttttaaaatccactgtcttctcttccatacagagaaaatatgtcctcttttctatacctaatgagtccactcatctcttgatcctgtttcttctgacagctctgggccttgttccatcaattaccactcctttgctcgaatcttcaattcattccctttgcctacttatgagagtatgtgtagtggacactgatctaccactcagattccctttcaagattgaaggattcagtcccccagaagccaggaatgctgctggaagatggcccttagccatcagccttcttcaggaattgcctcagcagaagaaagtcacctcactagagttcatgtattcttccctgggcagctctcctctaacaactgggttaatgtggggaatataaagaccagccctctcaccttgagacaactgtgaagggtcttcccagtttcagagctccttaagtcttggctaaggtcttcattgagactgcatcattgcccagcttctcccttagtccaatcttgtctcctttcctttcctcgctttccacaaattgttaaatgtgacagcactccctaattaacttcctgcatgctaatcatctcagagcctgtatcccagggtaccctccttatgacagtatgtttgtaagacaaggacttttaataatttgttaggtagtaccaagttgccctttcaaaaagctgtacaattttgcactcccattaccaatgtagaaaagtgcctcttttcctacaccctaattgccactactggatattatcaagcttttaaatcttcccattccataagtgacagatggtggcttattcttgctttatttgtatttttaaaaattatgagtatgagtgagaatgtttttacacattacttactggctatttatattcctttccctttcatttgcttgtgttatttgcccatttttctattgcacggccatacatattggtaatataccatatgccatacgtatattaattttcaagtaccatttgtatagtaagaaagttgcaaataagttgtttcagtttgctgtttgtttggctttaagactttcttctggccattcaaatgttttgcattttttaaatttgctaacattaccaacatttttcctgtgcttcttggttttctgtcaggcttaaattggcatttcccattctaagatttggggaaaaaaaccaaaacactaatgtcttccttaaaacttagctcaaatgtcattgctctcacaaagatgtctctgagtaccttgaccagagttaaccccccaattcccttctccctttatataatataaatcacattgcctatcatattctgccttaacattatggccatttttattattttccaaactcttctattggaatgtaagttactgaggaaaggaattccattttaaatctctatgtatgccctccagtatctagaatgacttgcgtaaagtcctacttaaatatttactgaattgtaataactagtactgtttgattatgtggctctgacactaagggtgagtgattttatatatatgtatacatacacacgtgtttgtatatgtatacatatacacgtacatacatatatttcacactctttctcattagacataaattttgtgaaattttgtgactatttttttgcttggagaactcttagttctgccatctttagacctcagccacacttaccaaagactgactgcaaaaacagcacttgagagtcaggtctcagggcctgccaagtgacaggtgaccagaacactcctagctgaggaggcagatcaggcagggtggttcctagcaacaggggaagcatatatggagccatgacacaaagtggccatcctccccacagggtaaacagagctcagtctcccaacaccatgaccatctgccccatcagtggcatagattcctcccaggccatacttttggctggggaagaagtccctgatgatgttgaggacaagatacaggcaggtatctcaactaggtcaatacattgagttatcagctcaggtggattagtcgttgcccagttcctatgcccagtagccctagtcttggattccatggtttcaatttctcccttttcattctcttgagcccattcaaatatggttttcatgccaccacaactgctcctgctcctgccaaagtcacaggtgacatcgacgttgctaaacacaatggccagttctcatttctcacctcactggccctgccagcagcattggcctggtggatccctctctacttcctgagggcttgattgggctccctgggcaccagtttttcctcatacctcactggatgcttccttctctgcctttcctggttcttcctctgcttcctgagcacttcacattggagaacccccaaagtacagtcattggacctatcttttctatctagattcattttcttgatgatcccagccaatcttataactttcgatactttctatctgctgacaaattccaaattttatatcctctaaccagactcataggtccaactgcctactcaccatctcgctttggatgtctaacagacatctcaaatgtaacattccaaaactgagcctctgatcttccccttcccccaaaatctgctcctctcacagtctctccatttcagtaaatgacaaccctatccaactagttactcacaccaaaaactctggtgtcatccttcactcctctccttttctcacacccacattcaatctgtcagcaaatctacttttactataccttcaaaatatactcagaatctgaatcctcctgacaaccactctgctaaccaccctgtgcaagttactatctcttaagtgtctctcttttctcatcaataactgggggcaataatagcctatgacttacagggttcttgtgtggaataaaagataagacatgtaaagaacttagcatagtgccgaacaaattgttagtgcttggccagtcatggtggctcacacctgtcatccaagcactttgggaggctgaggagggaggattgcttgaggccaggagaccagcctaggcaacatggtgagatcttgtctctactaaaattcaaaaaaattagccaggtgtgatggtgcgtgcctgtagtcccagctacctggggtactgaggctggtggattacttgagccctgaaggtcaaggctgcagtgagccatgatcatgccactgcactccagcctgggtgacagagtgagaccctgtctgcaccctcccccctccaaaaaaaaagttgttagtgcttaataaattttagctttcattattatttgtggcgtcagttttctaggaggtttcaagaagacgtggctagtaaagttgaagctatcagttccttttcataagaactgagttttttcttcaacacatgaaattttcattttaaaggttttacctaaatgagctaaagagaaagaagtccaaactaatctcacccagtaaaactgtcacagataagatccaaataaagggttaaaaagcacaatagcaatttgaatcattggaattcttctctataaaagtaattttcagctaacctagaaaatattttaaatctaaagttatataagattgtcacatatcatactgcatagctgtctacagccctagcttcacaacctgaaataatttggggatatgaggaaactcataggatgtttctacaacagcaactgagataacagccatcatttgtataaaacagccttgttttataaacctaaagtcccagctaattagtaataggtagaaagattctggaaaatcctcagtgttatctgagatgtcagcaatatacaataggcctgaactatataggaaatatcttgggtaagtgacctaatgcataaattagatgtgtggatatcactaataagataaaccattgcactaaataagaagaaaaatatttcagagcattcaacttgtcctttaatgcaatcactttgttaatatatgtggtaagaaacagtatttgaatagataaaagtagatgagcattttttcttaatatttttcaaaaattatgtttcttctttattctttaagtatggatctctttcattatatatatgtctgtgtgtgtgtgtgtgtgtgtgtgtgtgtgtagagatatatgtatctctctatatacacataaatacatgaaacatctaccacgtgctgagtaatgaggaaacaatagtgaattgtttttattactaagctccttataaaaatattttgatcgttttgagtataagagccaggtaacagtggccttggagtgttttaagttggcgggtgggggagataaccctaatataaaatcatcaggaattgactgtgcttaatttattagattttcttcatctgtatttaattatacattatactctgtggtattcttagagtgatatatacaatgtaaacaaatttaaatatcacatatatgcaaaaattacttagtaaaggtaaactcccattaatacctactgtgggctcattttagctgatccatgtatactttgtatgctaattttatttatttatctgtttttttataggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaa

SEQ ID NO: 2240 - DNA, 3096 bp, Homo sapiens
agccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctc

SEQ ID NO: 2241 - DNA, 30745 bp, Homo sapiens
ttccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaaggtaagtcagatctgactctgtctctctgggagggaaacggccctgacgaaggtcctccctcagactctgtccatgctccaggacactggaggacagagtcctggtttctgtcaggattctctgttaagtctagtctctctctctctctatctcttctccctctctcattcaggtctccgggagatctctgttttagaatgggtataaaaattgtaataaactctgagtgagtgagtgagtgagtgaatgtggagttcaagggcttgcgcttgaatttccagtttgtagctccagggtgaaagctagggaattcgagaaggccctcacctgtggttccgtggtgacctcataaggcttagggcggcatcaggcatagctcgatccaagccaggggtttataccagcctgccaatgccaagaggagcctaagtccccgaaaggggagcagccaggagggcatctgactgatcccatcacgggaccccctccccttgtctgtctataaaaattgccatgcttgtttatataccccagtgcctattgtcctgtttagtgtctgtctaaatttcatatgtcggatcgtcgatactgcccaaaatgactgggcaaggacttcttcaaggtccttagtacagattttctatcccaggaggtcaaattcctcattagtcggttgggctggccatcccagtcctgcctttcctgtcagaaacaaattaggtgttgttatggggaagggtgtggaagacattcacccgtttaggatttctggcaccataaagattgctggcgtttggattgccataccccacgccccaacgactggtccaccttctccttagaccagtggtggatccaaaatagccaccctgctgacctccttactcaccttttctgtcatcccataacttttcccatgcccttaaataaggcactgtgcagagaaacctacacccatactgctctactctgtctggactcttattttacctcttttggctactctccaacctttagggaaatccaagtggcccctttcctcctcatccccatcccttaccctgcacatctcattttcctgtgttgcagcaagtccagcgtctctaagacttggctgtgttctccctccttaaacccgtgaaggaaaggaccgagtttgaacattttgctttcgagtcgtggagacaccaaagttatttgggatataagtcaagaagggggggtcacctaagtcccactggctgaggatcccttggacccacctcttatcctctccatagatctcgaagcttgaggagacagaccttatgtggcaagaaatattggctatagttgttttcctacttcttctagctataatacttctgttcttctgataccatagcctcccaggccgtgaatatctttgtccatgctgggtttaatatttttgttcaaaccttgttaattgcctccagaatagtaaactcttcttcccggccccataaagattggagtcctctccagtgtatgttgcagaatttctctctaggcttctcagatgattacggggtccgccttaaaaaaggcaaactctggacactctgcgaagtagaatggccaaagtttggaactgggtggcccccagacgggtcactacacttcacagctgttcaggctgtgtggtgggtcgttgttggaactcccggtcaccccgatcagtttccctacattgatcaatggctagatttagtccagagctctccttcatggctccactcgtgataaaactctgtagccattcgtgatcctacctccaaggtcctttttagccagacctcacttttgcctccaccctcagctccctcgattcctcctgtactgcctccttctgaagaagaggaaagttttcttcacccatttccaccaccctataaccctcctcctcccccagaatcttcccttgtctcctcaactacatcctctgtggcctctctgcctatatcctcccaattatggcctcagccggaggaggtggccccgctcctcccactgacagaggcccaaatccctttgggcagtgggcgttgtgctccatttttagtttatgtccccttctctacttctgacctgtacaactggaaggctcataatccccccttttctgaaaagccccaggtcttaacctcactgatggagtctgtgctccagactcaccggcccacctgggatgagtgtcagcaactcctttcatcccttttcacctctgaagagagggaccatatctgaagagaagccagaaagtatttccttacatcagccagcttttagagatagcccagagagttttcgacaatcgagaatttgaaaagcaaaaacaggtagctcaggcagctgaaagggctgcagacaaagcatcaaaaagacaggcaaaaagcttagtggctgccatccaagaagccaaaaaggaagggcccccatcacagagcactgaccaggggaccccgagtccccaccaggaaggccagaaacgtgagaggactcccctataaagaaaccaatgtgcttcttgcaagcagattggacactggagaaaggaatgcccattaaagccagaggagaaaccagaaaagaaaaaggtcctcaccctgccccgcagcagaggaatctgatgattgacggggccagggctctttgtcacttggccccgggaacccatggtgaccaccacagtggggggccagcctgtacgcttcctaattgacaccggggtggaacactcagtactccagacacccttaggcagtgtctaataaaaaggttgctgagtaaagggctactggagctattcaggaatatcctgtcacccactcacgagaggtgagtttaggacagaaaagagtaacccacttgttcctcgtggtcccagagtgccccttctccctcctcggatgagacctgcttcataagctacaggcgtccatctccttctcggcccaacaaactcacctcatgttaggggacacaatgccccctactgctcagctcctgctaaccacccttcggtcagaggaatatctcttagtttcaccctcacaactgccggagaataaaagtaatcctctcctactggctttacagactctgtttcctcatacctcccaggactggcaaaccaccatctgccagctgttgtagaactcctggccaccaccctgccggtccaggtcaaacaatatcctatgattctgtgggctatagagggaattaatcctcatattcagcaactattacaagctggtatactcacaccatgtgagatcgcctggaatattccatttttgccggtccagaaacccggaacaaatgattaccagcctgtacaggacttgcaggaaggtaacaagcagacagtcactgtccatccaactgtctctaacccttatactttactcagcctgctcccaccagaacatatggtgtacactgtccttgacttcaaggatgcttttttttgctattcctctggccccaaaagtcaacctatctttgcttttgaacagacatatcctggctcggtagacaccacccaattaacctggacttggttaccccgaagttttaaaaattcccccaccctttttagggaagccctccaacaggatcttttaccattctgagccagtcaccctaactgcactcttctccagtatgtagacgacctgttattggctactgaaactactgacagctgcctgcaacatactacggacctactttacctccttcaggaattcgggtatcaggtcccagccaagaaggcccagctttttcttcccagcatttcctacctagggtatgagacaaatgaaggaaaaagggcactcaccagtgctcgaaaggcagccatccttcaaatccccactcccaccactaagagacaggtacatgaattcctgggcaccgtgggatatggtcgcctatagatattggggttcatggaaattgccaaacccctgtacaccactactggagggaataccccgctggtttggactgacaaagaagaacaggcttttcaaaatctgaagaaggcactaactgaggcccctgctcttgccctcccaaatatctcaaaaccatttcacctttttgttcatgaaaaccaaggagtcgctaaaggggtacttactcagactttagggccatggcaacacccagtggcctatttgtctaagagactggaccctgtggcctctgggtggccaagttgtctgtgagccatagtggcaacagcaagccaggtccaggaggctgataaactgactctgggccagaatttaacccttacggctcctcatgctgtagagaccttgctacaaagtgcttctggcaaatggatgtcgaatgctcgcatcttgcggtatcagagtttactgttagatcagccgcgtttaactttctctcccacaaggtgtttaaatccagctaccttgttccctgatccagaccttaccacacctgtccatgactgccaagaactgttagaaactatggaaactggctgacctcatctccaagatgtgcctctaaaggaggtggatgccaccgtgtttacagatggtagcagcttccttgaacagggagtacagaaggctggtgtggccattactatggagacagatgtactgtaggcccaggcactgccggcaggtaccttggcacagaggactgagttggtaaccctgactcaggccctccaatagggtaaagacaaatgtattaacatctacactgacagcaggtatgcttttgctactgtacatgtacacagagccatctatcaagagcgagggctactcacctcagcaggaaagagtgtcaacaacaaagaagaaattttagccctgcttgaagctgtttggctccctcaacaggtggctgcaattcactgcaaaggacatcaaagagaagacatggccattgctcgtggtaaccaaagagcagactctgcagcttgagaggcagctcagctcctggtcgtgcctttaaccctgctgccctctgtgtcctttccacaactgactgggcagactacccagaatactccccagaggaagaaaaacaagcttcggatcttcaagccagtaaaaatcaggaaggttggtgaattcttcctgattccagaatcttcatgccccaagcccttggggaaacttttatcaatcatctacattctaccacccatttaggaggagtaaaactggcccagcttctaaggagccatttcaagatcccccaccttcaggacttaactaaccaagcagctctccagtaaacggcttgtgcccaagtaaacaccaagcaaggtcctaagcccagcccaggccaccgcctccagggaggcttgccaggaggaaggtgggaaattgactttacagaggtaaaaccacacttggcagggtataaatacctcctggtgctagtagacaccttttctggatggactgaggcatttgccaccaaaaacgaaactgctaccacggtagttaagcttttactcaatgaaatcatccctcaacatggactgcctgttgtaataaggtctgataatggaccagccttcacctcgtccatagctcagtcggtcagcaaggcattaaacattcaatggaaactccattgtgcctatcgaccccagagctctggacaagtagaatgcatgaaccccatcctaaaaagtactcttgcaaaattaatcctagaaaccagtgaaaactaggtaaagctccttcctttagcccttcttagagtaagatgcaccccttaccaggctgggttttcaccttttgaaatcatgtatggaagggctccgcctatcttgcctaagctaaaggatacccatttagcagaaatctcacaagctaacttgttacagtacctgcagtctctccaacgggtacaagacatcatccagctgcttgtcaggggagcacaccccagcccagttcctgaccagactgggccctgccactctttccagctgggtgacctagtgtatgttaaaaagttccagaaaaaaggactgactcctgcctggaaaggacctcatactgtcatcctcaccacaccaacagctctgaaggtggacggcactcctgcttggattcatcattctcgcatcaaaaaggccaacaaagcccagcaaaaaaaatgggtccccaagcctaggccaggccccttaaaactgcgcctaagttgagtaaagctatcgaattaattctttttatttacctcttctgtctgtttccacctgttatgtcctctgccccttcctactcttttctcctcacttccttcatgacaggatgtgtgtttgcaaacaccacttggaaggtgggaccctccaaggaagtctcttttgtagtcggtttatgtgctttgttccccgaccctgcccatacccttgaagagcaatgcaatctgccgatcatgagagcagggaacgctgaccttgctgcagggttcggacacaccagaagccaaactggatgtggaagttctaagggtgcagaaaaaaggctccagagcgttgacttttacctttgtcctggaaatcgccctgactctagttgtcgagattcttaccagtttttctgcccttactgcatgtgtgtaaccttggccacttactctggaggatgaacctgatcctcaaccctttccatagcttgtgcttcccatcctaagccgtgtactataggaaattgtaatcctcttactataactctccgtaaccctagtttaactcaatggtattacagcatgtcatagggattaaggctttatatttcaggatttgatgttggaactatgttcaccatccagaaaaaattcctggtcccatgaagccaatcagaactttaactgatttaggtgaccctatgttccaaaaacacccagagagagtcgatttaactgtcccactgccattcctggttctgagaccccagctgcaatgacaatacctccaacccagcccgatgtccattttggacgggatacatcacctccttaatctcaccaagcctaaactagcctgagattgctggttgtgccgaaaggccaaacccccatattatgttggattaggagtagaagccatgctcaaaatggactctctttcttgtcatacgtgcccccatgcccttacactaggagatgtgtcagggaatgccttctgtctaattagcgcaaggtataacttacctgcttctccctttcaggctacttgtagtgagtctctccttacttccttaaacccctcagtctcctaccaggcacccaaaaatacctggttggcctgcatttcaggcctcactcgctgcatcaatgggactgaacctggacctctcctatgcatgttgattcatgtactcccccagatctacatgtacagtgggccagaaggacaacttctcattgctccccctgaattgcatttcaggtttcaccgagctgccctactccttgtaccccttctagctggccttagcatagctacgtcagcagctattggcacgactgccctgattcaaggagaaactggactaatatcactatctcaacaggtagatgctgatttaagcaatctccaatcagccataaatatactacatgcccaggtagagtctctagctgaagtagttcttcaaaaccgccgaggcttagatctgctatttatctcccaaggaggtttatgcacagctctagaagaaagttgttgtttctatgccaatcagtctggagtcataaaaaatactcttcaaagagttcgagaaaatctagatagatgccagaaggaacaagaaagtaacaccacctttctcattcctggagtaccaaagtaccaaagcatgtttaactggaatccctggctaactactctaattactgggttggcgggacccccttctcctcctcttgttagggttagtcttcaggccttgtatattaaattggtttcttaattttgtaaagcaacgcatagcttctgtcaatcttatgtatcttagaacccaatataacacccttgttataaccgaggaatcaatgatctgattcccccaaacacgagtgggaaatgtgataccctaacttcttttaacctgattgactctctcttagctgagagagctggacagactccattttggtttcttcacttgcagccccttgtccccctcccttaaggacataactggtgcaagctgactccaagcacatccaagaatgcgcttactgataagatactgaggcaagctgtaccagcagctcctgggaacgcactcggttgacggtgcccaaagcctttgcgtttatcactttgtgataatttaagcccctgcacctggaactgtttattttcttattactgtttctgtaaccatttatctttcaacttttttgcctgttctgcttctgtaaaaaattgcttcagctacactcctcctcccctctttagaccaaggtgtaaaaagatgtgtagccccttcttcggggctgagagaattttgagctctagccgtctctcggttgctggcaataaaggatcactgaattagtctcagactgtggcattctctctataactcagtcggttacaataaaatagcaaaacaagttgccatttcttccatttaactccatgccctcctcctactgtaacccgttttctcttccattgaacaaaagacgttgataaaaataggagctaaagaaaatgcggataggaaatggatattatcagatcaaagggaaatgttgtcaaaacctctcatgagggaagtcttgtctcaattacatcaagggacccattggggaccccaagcaatgtgcaatgcagttctccgggtttatgggtgtataagaatttacaccctggccaaacaagttatagatagttgcttaacatgtaaaaaaagctaataagcaggatctaaggaaattgcgccttggtggaagaaatccagcactgagaccatttcaaagtgttcagatcaattacactgaaatgcctccaattggtagttatacttattagtaataatagaccattttacccactgggtagaggcaatcccattctcacgtgcaacctccagtaatgtagttaaagcgctaattgaaaacatcatacccagatttgaactaatagaaaatactgattcagatactgcaacccatttcactgtgcatgtcattaagaagttagcacaggtactagatatacattgggaataccatactccttggcatccatcctccacaggaagagtagagtggatgaatcagactctaataaaccacttaacttagttttagaaactcgattgccatggactaaatatactcctattgcttggttaagaatccggactgccccttggaaagatattggcctgtcacctgaggaaacgctctatggaatgccctacttacactccattgctgacatccctatgtttgaaacaaaggatcatttcctcaaaaattatatacttggtctaggctctaccttcttttcccttgggactaaaggtctcctagcacaggcatcacccctggagtttccagaacatcagcattggccttgagaccatgttctcatccaagggtagaagaaaaggaagctcgaaccagcctgggaaggaccctacctagtgctcctatgtactgagactgcagtctggacaacagaaagaggatggactcatcacacccgagtcaagaaggtgccgccacctccagaatcatgaactgtcactccacagcccacccccaccaaattaactctaaaaagagcttaataatcacttatttattctcttttttcttttcaacagaaggtcatcttgtcatcagtgtaactcaggctagtcattttttaacccttcagtttgatgcctgttcagtcatcccgtatggagatgagcaaggtcaaaagaagctagcccatgttgataagtgtctatgtctataccacaaaaaatcaagcatgtataagtatggagtgttaaaagtcccagtggtgactgggcagatgtttggtggactaataagtacaaagggtggagagccaagctccctgcttcaaataaattatgacgaccaaaacaaaaaactccaactagtccctggtcccaccccaccaaattgtaagccatgacactgtaaccccttgttgctgattataaataatccccggaccatggcccaagagccctctatattcaaacagtatgggctaggaggagatgttgaaggacagatccatttcttagagaaatgaatgtgacaatgaaaaatgacactactcttcgttcatttttctttgacaaaataatttttctgtcaattttgtatgtatttaattttaaccaagtaaagcttcttatggacatatattcatcagatttaaaaaatgagtttcttaaaggtgcaaaaccaggaatagcttggtaaattcatgaagctagaaagtagctaatcaaagttcttattaaaccttctggggttgattaagagtagccaaaattatgccaggtgcagtggctcacgcctgtaatcccagcactttgggaggccaaggcaggcagatcccaaggtcaggagattgagaccatcctggccaccatggtgtaacctcgtctctaacaaaaacacaataattagctgggtgtggtggtgtgcacctgtagtcctagctacttgggaggctgaggcaggagaattgcttgaacccgggaggcagaggttgtagtgagctgagattgggcaactgcactccagcctgggtgacagagcgagactccacctaagaaaaaaaaaaaactattagcgaaaattccttgtaacaaatcccctcaagaggtgaaatctatttccctactccttggccccgtcctggccttgagacttgctttgatcaatagaaggtgacagaagtgacactgcacacattccaagggtaggcctcctacaatgctgctacctatgaacaagcccaagttagcctcatggaaaacggaaaacacataaagagggtccctgtcttccctgacaacccagtccacccagtgaggcccacagaggtgaggaaacccagctgataccacgtggttctgagatcggcttatcagctgattcctgcccaaattgccaacccacaaaatcacgagcaaataaatggttgctgtaataaccagttgggttgttacacgaaaacagctaatagatataccttcttaatctcaattatctaaaaaagatatccctcctcactgattcatagctaagtggttctagaaggaatatttttatgaataatacacatttctttattctgtgcatcacatgaaaatggtcagaatcaaaatggagtcactaatgttaaaaaacaaacaaaagactctgacaaatacagctgggaagaccatgaaaagagggttctaatggttgtacacctgaaaaccaaaagtaccacgaaagacggcgaacaccacaaccttgagcaaaggccattccaactgaacagaaaacatactctgcaaggacctctgaacaactgcctgtccaacctcagactaacaccactttcgtgattgatctttggagccaaggctaattaattcaaagaaattagataatcctcattttttccttaaaaaatttttgttttcctttattttcccaaatatacacatagtttactgtggcatgcatactcccattgcagtggtctattcccagagaaatatttttcttttagggacctctctctgttatttaggtttatagtcacaaaggatttactatttcaacaatactagcactgcatatcatccagtatacactgggaaaataaggtgccccatgtgcagatccaggagactttgtgaccaccagattatgaggcatgcatgtatttatttatttatttttgagatggagtctctatctgtcacccaggctggattccagtggcataatcttggctcactgcaatctccacctcctaggttcaagtgattctcaggcctcccaagcagctgggactacagatacgagccacctatgtggctaattttaggatttttagcagacacagggtttcaccatgttggccaggctagtttcaaacacttgagctcaagtgatccacctgccttggcctcccaaaatgctgggattacaggtgtgagacaccatgcccggaccatgcatgtattattaatgttgaagtagataatttaacaaacatcaatgaagtgttaacatttttcactcataggtgcaaaatatcatgccaattgccttctatgagctgtcgtaagccacagcctagagattcaattccatttcaagattcaaccaaagccaactcatcaacaagaacatgtaaaagacagaaaaacccactaccggcaggctgaaacagatgctgtgacgtggccctggcctgtcatggcatgtcacagcatggcacaggcctatatcatgttccctagactgctgactaccaactagttacagctgactccaatcaggtcgggatttgaccatctctgcactgaacctgcaattgtaacttttaaaattgaaacgctgcttctcacctctcctccctagactccatttcacagggaaaccatcacagggaaagaaagcctttgttttttcttccttctttgctttgctttctctctttcttttacacagggtctcactgtgtcgcccaggctggagtgcagtggcacaatctcggctcactgcaacttccacctcctaggttcaagcaattctcctgtctcagcctcccaagtagctgggattacagacatgtgccactgtgtctggagttgattccttccagtggttttgtggtctggctgacttcaagactggagcagcggaccttcacagtgagtgttacagttcttaaagatggcacagacccaaagagtgagcagcaggaagatttattttgaacagcggaagaacaatgcttccacatcctgtaagggtacctaagcgggttgcctaagcgttgctgctgggggctggggtgaccagctttaattcccttatttgtccctacccacttcctgttgattggtccattttacagagtgctgattggtccattttacagagtgctgattggtctattttacagagtgctgattggtccattttacagagcgctgattggtccattatacggagcactgattggtccattttacagagtgctgattagtccattttacaaacctctagctagccacagagcactgattggtgcattttacaatcctagctacagagtgctgattggtgcatcttacaatcctcttgtaagatagaaaatttctccgagtccccacccaacccagaagtccagctggctacacctctcaccaccacacctacctaatttctgtatttttagtagagagggagtatcaccatgttggccaggcttctttcttaatcttttcttttctttctttccttccttcctttcttccttccttcctttctctttctttctttctttctttctttctttctttctttctttctttctttctttctttccttctttcttccttccttctttccttccttccttgctcccttccttcctttactctctttctgtctttttctgtctgttttctctattccttactcttccctcattccttccctccctcccccaactcttctttccttcctttctctctccctccctactttccaactttgggctgtgttgaatttgttgactcatcgtgaacaaacagaaactccaatgatactgttacccaagagaactttgcaaaaggttgtcatgtttaataattcattcacagaatcctcaatctcacaaaagcctggaatggattttctgtttggacagggcagggaagctactgtggccaggctccagctcttcccactgcagctagcacaagccttctaaagcaggatgtggccaggcacagctcatgcctgtaatcccagcactttggcaggccgaggtgggtggatcacctgaggtcaggagtttgaaaccagtctgtctctactaaaaatacaaaagttagatgggagtgatggtgggtgcctgtaatcgcagctattcaggatgctgaggcaggagaattgcttgaacctgggagacagaggttgcagtgagccaagatcacaccactgcactccagcctgggcatcagagcaagactccgtctcaaaaacaaacaaacaaaaagcagtgagaggtgaagccacctggacttcctgggttgagtggagacttggagaacttttctctttagctagcagattgtaaagtcaccaatcagtgctctgtgtctggctaaaggattgttaatgcaccaatcagcactctgtaaaaatgtaccaatctttcatcccatctcatcccatctttcagtcacttcacaaatggttcctagtagatacaaaacagttttttctccaatgggaaaacagaaaacagccactcagtttgctcccaacacccgtttctagccgcttaccacagctaccttggcaagtactctaggagtatgggaaaatgaaaacgacaaactcacacacctttttaacatacacaaccagttctgactacctagccaaggcagattcttcttctgtggaatgtcaacctatatctgcctcccgaccaactggacaggcacctgcaaccttagtcttcctatgtcccaacattaacattgccccaggaaatcagaccctatcagtgcccctcaaaactcaagtccgtcagcacagagccatacagctaatacccctgcttatagggttaggaatggctactgctatgggaaccggaatagccagtttatctacttcattatcctactatcacacactctcaaaggatttctcagacagtttgcaagaaataacaaaatctatccttactctacagttctaaatagactctttgacagcagtgactctccaaaaccactgaggcctaggcctcctcactgctgagaaaggagggctctgcatctttttaggggaagagtattgtttttacactaaccagtcagggataatacgagatgctgcccggcgtttacaggaaaaggcttctgaaatcaggcaatgcctttctaattcttacaccaacctctggagttgggcgacatggcttctcccctttctaggtcccatgaaagccatcttgctattactcacctttgggccctgtatttttaacctccttgtcaaatttgtttcctctaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcagtaagtggctagagaggtcatcacccaattcccaacagcagttgtggtgtcctgtttagatgggggattgagaggtgaagccagctggacttcctgggtcaagtggggacttggagaacttttctgtctagctagaggattgtaaatgcaccaatcagtgctctgtgtctagctaaaggattgtaaatgcaccaatcagcactctgtaaaaacgcagcaatcagcactctgtaactagctaaagggttgtaaatgcaccaatcagcactctgtaaaatggaacaatctgcaggatgtgggcaaataatggaataaaagctggccaccccagtcagcagcagcagggaaccgctcagatacccttccacaccgtggaaactttgttcttaccctcttgacgaaaaatcttgctgctgctcactctttgggtccacaccacctttaagagctacaacgatcaccacgacagtctgcggcttcattcttgaagtcagcgacaccacaaacccaccagaagggagaaactccagacacatctgaaggaacaaactccagacacaacatctttaacagctgtaacacacactgtgaaggtccacggcttcattcttgaagccagcgagaccacgaaccctctggaaggaaccaactctggacacagcaggacgtgagacttctacctgctcactcagaatcatttccgcaccaaccatggccacgtttgtggagctcagtacaaaagccaagatgcccattgtgggcctgggcacttggagggtaaatatgcaaatctttgcacaactttcttctctggagggctgtttgggtgttttctctttctacattcagccagaaaagcctggaggtcgggtaggggtttggagaggtgaatttcagtcctggagctgggactcgggttgctttcttttctcaaagctgattcaagctgcaatgctgcaagactggctttcccagcagtgatgagaactcctctagcaagtatcaaatttcaagcagagttggacttaaaattgttttccagggcagtttctctctctggctctaggacacttaattgggcacaaggtttccccagagtcttggctgtgggtttgttgtgggctgggtggttgtggagaggatgcagagccagaagtccctggcaccactttgcagatcaccatgtgggacttgggctagcagcatccctatgacctgggagcttgttagacatgcagaactggctgggtgtggtggctcatgcctgtaatcccagcactttgggagatccagacgagaggactgcttaagcccaggagttggagaccagactgggcaacatagcaagacccaatttctacaaataatcaataaattagctgtgcatggtggcatgcagctgtagtcccagccacttgggaggctgaggtggagattgagtgttgagcctgagaggtcaaggctgcagtgagcagtgattgtgccactgcactccagtctgggcaacagagtgagatcccgtgtaagagaaagaaagaaagagaaaaaatgcagagtctcaggcttcacccaggctacctaacgggcatctgcactttaacaagttccctaggtggttcctgtacacattgaaatctgcaacatgctgggactgcagagagcctgggctgggagtcgtgagctccacccggctgtttttatgacagctggcaaaacacgctaaggcacattgaggactcagtgaggcaggttcctgggcctctgttaggctaagtttgaagttgttccatcactgcctccctctgccttctttgccatttccatccatgatagcactaccctaactagtgatgagaagcagtctttggagttcctcttctctcctgtccctcatggctaatttccctgctcagacttctgcctctggctctctttccttctgtgcacactgacttttttccctctcctgtgccgagctggagggtaggaccctctgctgcagcactgggtcattctcaggataaagtcttggtctatctgggcgaacagatcacttccagctcgattcatacatactgactcttgcttgaatagcaagatttgccccaaatcagagctttaatcctatataaatggaacaaataatcacttccagatctccagggaatctgctcacccttcataagtttactagacagtttcagaattttggaattgaatgtaagaattatgaagggagctgccttcaacacgtggggatgatagattaaaggattatgaacttagcagtggaggtgaagaagggtgtagtatagcggttggggtcacagggctgcttctagatgccaggtggcagcccgtttcttgcccaggtggtagggtagttgtgcatctctgttttgtgtacttttcaatgtttgttacctcacaatagaagaggtttaaaagactattttgtgagagatcaagttttaagtgctttttgcccccatcattggcttggctaggttagaacaaagtgtgataattgtatttcctttttttcttttctttccttcccttctttctctccctctctctcgttctccctacctcgctctttctttttataggaatggaaaacaaactctattcctataagcttctctatttctcctttttttccaaaatgatcattgtataatggacggcctgtactgagcctgtgtgtcaggtaatgtggttaacttaacattcattacagcatgtcatcaccacaaaggcctcttgtggctggtgctatttttttttccattttgccgacaaggtttagagagattgaatcacctgcttagacccacacacccagtaagtgttggaatctggattgatgctgtaatgaccattatccagatccttatcaccgtttggggaaattgtctgaaaatccctctgggttatttagagtcaagctttcatctgggtcttcagaaagttgtagtggagccatctgcaccaccacacacctgaagacatttcaggactaacctggatgaaaagggaactgacttttagctaggataggacaaaagggcataatcataaaattaattcactttccttcctttcttttgaaaacttttctaaactgtgtatcctcccagatattccctggcaaagaagaccccagcgaagccttggtttggagaaactggaccgtgtggggcaggtgaaggtggtctggggataagagaatatggtggttgctgagtgtggtgtaattccagctactcaggagttgggaggattgtttgaacctgggagtgtgaggccagcctgggcaacatggcaaggtctcatctcttaaaaaaaaaatacatgtgtgatgggcttttcttttgcttttcagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgcacatggcgcatttggtgggaggccttcacttcaaggcaggcagaagtatctggatcgggtgggcagcaagaactctgtcggccttttctacgtgtacccgttttcatctctgccttgataacatccgtggatacaatactatccatactccaagccgttattgatatttgaacatgtcgtggctgccccacctgcctgcgggttggatttcccatagtgggcttggctccctctgggcctccctgttccccatcagagggatctaccatctgcccagaggcagtcacaggccaagggtgcaggcagggcttgatatgaagcctccctctcagcactgtggtctcagcgactgtgcccctgaggttctcagccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcagggacccccaacagagagactggctgaagccatggcagaagaacataaattgtgaagatttcatggacatttcttaattccccacattaatgtttttataatttcttacgcctgtctttactgcaatctctgaacataaattgtgaagatttcatgaacatttatcacttccccaatcagtacttttgtgatttcctatgcctgtctttacttaaatctcttaatcccatcatcttcgtaagctgaggatgaatgtcgcctcaggaccctgtgatgattgcattaactgcacaaattgtttgtagagcatgtgtgtttgaacaatatcaaatatgggcaccttaagaacaggataacagcgatgttcagggaacaagggagataaccttaaagtctggctgcctgtgggccgggcagcacagagccatatttctcttctttcaaaagaaaataggagaaatattgctgaattctttttctcagcaaggaacaaccctgagaaagagaatgcgctcctaggggtaggcctctaaaatggctgctctggggacggctgtcttttacagttgtagataagggatgaaataagccccggactcctgttgtgctcccaggcttattaggacgaggaaattcccacctaataaattttggtcagaccgattgtgtgctctcaaaccctgtctcctgataagacgttatcaatgacaatgcatgcccgaaacttcattagcaattttaattttgccccggtcctgtgatcttgccctgcctccatttgccttgtgatattttattaccttgtgaagtaggtcatctctgtgatccacaccctatttgtatactccctccccttttgaaaatcactaataaaaacttgctggttttgtagcttgagggcatcatggaacctgccgaaacgtgatgtctcccccggacacccagctttaaaaatttctctctttgtaatctttccctttatttctcagaccagccaacacttagggaaatagaaaagaacctacatgaaataacgatgaattatcaggggcggattcacccaatactgagcaggtgccagaaagtagtagctgcaccagggctgcagagtggtgtggactggagcaggagagcttgcacttcataattgggaatggcaggtggtcaggaagagaccttggagcagaaagatgctggctggaagggaggctaaggccatgtgcgctgctgaggtgctcacatgcctgggttatcttgcagttatgtctgagagaagacatgatttctggcagcccagacaagttgtaactgccatatcacctttgtctagattccatgccctggggttgccctcccaggaaacctcttgggttattcttccataactgtattccagggcttaattattttattaagcaaagcacacctggcagtggcatcttggagaaaagtccaagtatggtgatgctggaaggaagccagtagtgatcccagcacccattgcctggggctctgctcttacctgctcctgaggggtgggggagacaaatttccagctctctcccctcctgaccagctggagtgatgatggcctgccatcccgaattccacgcctcttctagaggctgcaaggatagaagttggccaatatcttctccagaaaaccacaccctggagatctaatctttatccagtgatactgaaatgaaagtttgcccttgggtgtgtataggatgtaggtgtgtgaggttaatgtccatggtgataatggtggcttctggaatgtactaacagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaatgttgatttttatttatttttttcatgataaaactttcatatttccatggtgtatggaactataattttttatgtgtttctttacgtgtaaggtgagagtggcaagaacataaaatctttacctgttagttttagattttcttgggctggggaggggcagtagggctggaaccaatcactgatgggcacccaggccctggactgaaatttcctgtgaatgcttcagctaactctgttgcggtggatcctttagcaatttctgccccagggaagactaaggcaagccagggtccctgtagtccctctagagctgcccataaggtattcctttctatgataggccatggaggagctggtggacgaggggctggtgaaagcccttggggtctcaaatttcaaccacttccagatcgagaggctcttgaacaaacctggactgaaatataaaccagtgactaaccaggtaaattctattcagtttaagggtaagggtcctgccctattacttcttaaacattgcggggggaatgttcaatgctatgccctgagtcttatctcaggggtcagtgatcaggacactttggggaggtgtgaggctgatctcatgggtgatttagcaagaatctcagtgcgcacttgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgtcggtatgggtccataagttactggaaagaaaaatgtgtgtaaggtaacacgtttggtacacacaaatgggatggcagtgggaaaaaatgggaattaaacaacaacaacaacaacaagggcgacatgcttgaccctctgggaatatttccagttcagccacccaagggtgaaccaggcttgcaaaatgctgaggcttcagagcccggggaaaggacccaagcttccaggtcctcctgcctgtctcccagatggagaggctctgatgatcagtcttgagaccctcattggagtggtgtccttctgtacacggtagccatggtgattattcacatcagcatctttctgcccctagggccaaacctgaggacccttccctgctggaggatcccaagattaaggagattgctgcaaagcacaaaaaaaccacagcccaggtaccatatttttatttttcttgttatccaaccactcatgcttccagtctcatgtttcatttctcgtgttgtcctcaactgactccttaaaggggaagaacacaggagctgaagccctctaaagtatttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtccttgtagctgagtggaaacatgatgtcccctttctgcacaggttctgatccgtttccatatccagaggaatgtgacagtgatccccaagtctatgacaccagcacacattgttgagaacattcaggtaagtttccggctggtcgggcctggtattcctcagtggagtgggggacaggcagaccttctcactaggcttctcacctcatccctgcactgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctaggccatacacaagagcagactgtcctggcctacctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccttggacagaatgggaaaaactcctatggccagtttgtgctgtgaatgtgagctccctccctgctagaatggccggcagtctccagccacagcagtaacagccttaccgataatgtattggaattctttcctttctaggtctttgactttaaattgagtgatgaggagatggcaaccatactcagcttcaacagaaactggagggcctttgacttcaaggagtaagtggcatggagttaactagaagaattgccaggagtttttctaaactggtagagggttagttggaaggattagaaggttgttgggactacttgtgtcttcaaatactattttggggcagttttgaaagttaaaatttgggtacctgggaatcactgtaagggacacatctctaattgctgcttattgtctgaacttctggatgtagagctagaattgtaagagaaggtgtgttatcaataggcaggaggcagaacattcatttattcattcattcagtcaatatctagtggtcatctgtgtgccaggcattttctaggtgcttgggttatcatactgtacaaagctgctgcctccacaggcttagggagggagggaagaagagacaacagaaataaatcaactcaaaatattgatgtcagacagcaacaaatgctagacagaaaagtaaagtagggcaaagtggacaggaagtggtaggtggtagtgggactgatcctttatacgggttgggtcaagggaagctttgctgtgagggatatgccatatgtatatttgggggaagagcattcttggcagtgataacagcaggtgcaaagtccctgaggtgggattgtgtttagagcattcaagcaagaaggccagggaggctggattaaatcatctccaaatgcctcttaaaggaggtggtgctaactttactttaaatctcagataagttgttgaaaaaaagtctttcactctggctaggcgggaattctacatcatctctttagaatcaatactttctgattaatgtgtctaattacatatatcaaatagaattgtctggcatttattactgcgaggtctgcaattcaatggcaatttgaatttcttcaaatatttgtgtagccaaaaatgatttttcagcttttaaaaatgatttcagtatctcaagcgttgcttgcatgtcatgatattccatatctatcctgcccaccctcagtatcatagcagcctttcctcatcttacaatggcttagtttcatccgtgcttaacaaagtagcagctatttagagtaaaaaggaagggtgaacataagatgtgactctcccccaaactaaaacacttactttcctatgagcatcatttctggtgtaggcaatgggttggtggactcagaagtaaatccacctggcctcaaatccaactctaacactggtttcttcgctgtgtgacattgggcaaatttcttagtttttctaagttggtttctttacctataaagtaggatgataatactaatcgcagctaacatccattgaaccttagcttagaatgtgccagggtcctgagcccttttccggtggtattatctcatttaatactcataacaatccccaagctgtcaattctgctgttgtttcctacctcatgatgttgtgagagtggattgggacaagacttgtctgtcacctcgcctgacaccaggcttaccgtgagttgtcattacgagtttattctgctgccctgctcactgtctgccctccttcctagcaaaaccctcatatcgatttgaaggaaggtcaaggtgtaagcacccttcttgtgttcttgcagggaggaggctgagagaccacaaataccacagagtccaccagagaagaataccttctcagcgagagttgttgctttgatggaacacagtttctttttttttttctctctctctgtagattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaa

SEQ ID NO: 2242 - DNA, 31376 bp, Homo sapiens
caatcctggactctcccgacccctagctgtcggtccccctccctgcgcgcgcgccggcgggtttcctaccctccgaggcgtccgctggcctgcgccctggcggggacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccaggtgcgtgcagcccccgcgccggccgaggatgcgagacgctgggccaaggccccggggaccggagcaggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtgacatggattcgttgcggtctgaaaagacttccggttagggccccctgatcaggactgagggtcgtaagcttagtgggtgcctcctccccaagaaacaggacgcacagctgttgtgtcccctgggaaggacacctcagaggaaacctcgaggtgcctaaggaacctcgaggttctaaggaaacctcacagctccttggaggcatcagtcaggagttgggggggtaacttcccacctgctccacccagagaagggtcaccctgaggagctgctggctggcctgtgcccaccccgcctcccctctacacggacggagaggaagccaaggtcggcgggaggtgggggagagactccactgtccgactccctccggcctccccagaggagggaaggaaagggagaaggggctcctgactcctgcaggtcctgaccccgcagaggggcgctcagcacctcttcggaaaccccatttggggccaatattgcacctgggcttctctttcagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggtcagtagccttaagccacggggtcctgccggctatggcccttccccgcaagagcttgcccctagaacccacctcttaccacagacattcagtctgagggatttgaaatccccttgagattgtgtgtggtgtgtggtgtctgcgtggtgtgtctgtgtggtgtgtgtgtgtggtgtatgtgtggtgtgtgtgtatgtgtggtgtgtctgtgtagtgtgtggtgtgtgtgtgtatgtgtggtgtgtggtgtatggtgtgtggtgtgtgtgtatggtgtgtggtgtgtgtatatggtgtgtgtagtgtgtggtgtgtgtatgtgtgtggtgtgtgtgtatggtgtgtgtgtatggtgtgtgtatgtgtggtgtgtgtgatgtgtgtgtgatgtgtgtgtggtgtgtgtgtgtggtgtgtatatgtgtgtggtgtgtgtgtggtgtgtgtatgtgtgtggtgtgtgtatgtgtgtggtatatatgtgtgtggtgtgtgtggtgtgtgtatgtgcatggtatgtgtggtgtgtgtgtagcgtgtggtgtgtgtgtagtgtgtggtgtgtatgtgtggtgtgtgtatgtgcatggtatgtgtggtgtgtgtgtagcgtgtggtgtgtgtgtagtgtgtggtgtatatgtgtggtgtgtggtgtgtgtgtggtgtgtggtgtgtgtatgtgtgtgtgtgtgttttgaatggtgtgatagtatccacccagaggtcagggcctctgcaggattcctgcattctggttggaggcagtccctgtagaactcagaaggaagagcctctgattccaggccccacaggcatggccagacctctctccccgcagctgcttcagtgagagttaagtaaccacttgccagttttcaattgattagtaaaactatttgagctggaacttctgaggaggaaaaccaaagcccctaggccatgctagattgcaggtgtgaaacctcatggaaaagcagtttcagtggtaaaaatgtggagcttggattgggaggacctcgggccccatcagagtcccacttctccactgagctgaaactggcaacaaatgactgaccctcactgaaggtccatttcctttatgtaaaatgggaaataaataatttgctggggtctatgaggggaaaaaatgagatgaggattttgtaattcacgtgctttaggggagtacaatattattattattaaggaagagctctggagttattaaaactagccttttttttttttttgagacagagtttcgctcttgttgcccaggctggagtgcaatggcgctatctaggctcactgcaacctccacctcctgggttcaagcgattctcttgcctcggcctcccgagtcactgggattacaggcgcccgccatcacacccagctaatttttgttgtttttagtagagacggggtttccccatgttggccaggctgctctcgaactcctgacctcagatgatccacccgcctcagcttcccaaagtgctgggattacaggcgtgagccactgtgtccagcccaaactggccactttaataataaaactgccttgggtctgaaatgtgacagattttatcttgggaacaccgaaggggaaacttctacacggagcttgagatgggctggattgtccccaccgtccttggcagatcttaaagctctgtgactcctgaggggagtctcttttgtgctagagagccatttgttaagtattcagaaacttggcaggctgactgacatcctgttagcagcttcaaacttggttctagtgagaaatcagcaaactctacaaatccgagctttgtattgatcgttcctggagagtttgttaaacatttaacagtataccactgggcatttgtccgtatctatcatgagagacatttaagaacgcttccctgaaactggactgacctcaattcaaatcccagtgtaactgaagttcagtttcctattttgaaaaacataagatttttttttctacctcttaagggttactaggaagattaaatgagataaaacagggaaaagacagcacagcaccagacgatagatcgttcttattatttcccattatctctagcatttaagattgaagacatatctgtttttcccttgacattacaagggtcctgtaattttcagcagcatattgaatgcttttgcctcccaacctttcttggcaaattagtgcctaatgacaactgaagtatcccggcctttgaatgaaagggccaggcagtgacccgaggggtgggtggggtgctgccctgtgctagtccagtgctggccagcagagggcaccccagataaccaccaccacctcgtcccacccctcccccatgctctcatcccccagcccaggaagtctgaggtcccatgcatgcaaacaatggctcggatcatccactacttgtatctgcccaaaacttagtgggttgtgctgtgctctgtgcagaacacagccttaatcttctgaatccccagcaatatcacactcaatcagtattagtagaagggatgaaggagcaaaacagaatctggctgagaagagggctagaagcaagataataatgataataatgaattctgctttattggaaggcctagtctcttactgcaacatggaactattttttgcatatacttaagaaaagagatgatgtgagcaccagtcaacagtatcaatctttgtttcagacaatcagggtttaaaaaatcctgagtgctggactttctagggggagtgaggaagacttaccctaggttttctgctacaggaagagacttcttgtcctttagcccagtggttctcaaagggagaggagaagaggattcccccacccctctcccaggggaaaaatggaaacatttttggttaccacaactgaggggaggatgttagtgggtggagcccacaacaaagaattattctcccagaatggcagcagggccacgggtgagaaaccctgctgtagtctaatgattctgtagcagaattcacaagtggcagccacaatgctgtgggtttattcagcagaacttttccctgcagggtttctctgcccagtgagctccctgagcgtcacagcttgagtgagggaagctgcttttccctgccagagcccacacagcgaaggaggaggagttgtgccagcccaggaagcggttctagtgtggttttgccatcagccccagccaatcccagggttcaggcctgagggaagcctccagctcactggcacctggaagatgagggtgccagaacctgtatgccctggagttcagattgaagcgaggtgcatggctttgttcagaaaagctgcaggcagcttctgggtagtaacagcaagtgcaggattgtgccgactcagggacagtcactcctgaggcagtgccatccttcgctgggcagctgcctggcacaggggttctttctctcctgtcccccacactcctcgatcccctcccatcctcagggctgctactcccagcttccatggctggtcaaagcttggggcttgagtcttttggaattatctaattcactctgttcttcctttcatggacttcaggatgaccacaaactcagcaatagggaattggaagagaaatatggcacagacatcattatggtgagtcgtgggaaccagggatttggaagagaagcctcccaactctacagagggaaggctgtgtgtggcggggggctgtgtggaagagtagcggcacctttaggaggaggggcccctgcagcgcctttgagactgcagttatttgcatctggacacagttcaagtcaacagaaaaacctactgtggggctcacactggcctggcagtgagagggaccaagagggacagatgacccctggcctcaaggagaaagtggccgggtaggggaggcaaatgtgtatggaagtgtcctgagattcactctatccccctgggatggctacaagaagtagaaacgctatgctgggacaaaggtggattctgatggaaggggccagagccagctctcgggctgctgccatgtttgcgctgggactcaaaatgcttcggatttaagctggtgggggaccccagggccagtaagcacagagcctgcttggagagaatctgggcttgccggaagctagtatgtgtggagaggggacaggtgcagcaggaatgaagccaggaaggtcatctgggtgaagctgtcaaagtattcacattaaactaatgagtaggagctgtcttagaggcagaagggacatggtttccacacatggaggtgctttcattggttttcaaaaggcagttctcatagaagattctttttttaaagtgagaaatggaagggtctagaagaatggaacaacagcccaggactgtgaaatgaggatctgaaataatgtcgaaagacattacaggggccagacgtggtggctcaggcctgtaatcccagcactttgggagactgaggtgggcagatcacctgaggtcgggagtttgagaccagcctgaccaacatagtgaaaccccgtttctactaaaaatacaaacaattggcagggcgtggtggcacatgcctgtaatctcagctactcaggaggctgaggcaggagaatctctgaaacccaggaggcagaggttgcggtgagccaagatcatgccattgcactccagcctgggcaacaagagcaaaactccatctcaaaaaaaaaaaaaaaaagggccgggcgtggtggctcacgcctgtaatcccagcactttaggaggccaagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaatggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacacaaccagcaggacttgcggggatttttattgagcccctcatctcgctagtcatgtcacagcagcaggaggaggagagccggtcgggtgatgggctggggtgggggcagggaggtgagagcagggaaggcaggagggtggaggcgatgatgaacttattgtgagttataccaggagaagtctctccggaacacccctgaggaaatgttccacagttattcagaaagatgagtctggggttctggaaaaggaattggagtggagggagatgggatcgaggtggtgagcctgaatctagccattcaacagatatttgaatcactaccacagaaaaagcatgagacccgggagagaacacaaaaatgaccaagactggcctgtcatggtggcttaggtctgtaatcatagcactttgggaggccaaggtgggcagatcacttgaggtcaggagttcgaaaccagcctggccaacgtggtgaaaccctgtctctactaaaaatattttaaaaattagccaagtgtggtggccgctgcctgtaatcccagctatttgggaggctgaggcaggagaatcgcttgaacccaggaggaggaggttgcagtgagacgagatcgcaccagtgcactccagcttgggcaacagagcgagactctgtctcaaaaaaaaaagaccaagacagagtcctgccctttaagtagcttacaacataattagggagaagaggtatctacagacttgtccaccaaagatcgtctgtgggggaaattcctgtgaacatgtagggtttcaaaggtgagggtgcctcacggatggcaggccccccagggcaggggctgctcacatgggctcagggcttgggtaggatttatgcctgtcaagatgaatgagaacttaggctggatgtgtagaaaggtggaaaaggagcaggcgtaaggatggaaactaaagccacatgctctctgtgcaggattccagaagcttccctatttcctggggagttactgcattgcccttagccctggtgagcagcttcttcattccaagtcctccttcatcaaattagtcctctcaccggataaacctctaagaaactaaaaccccttagcagagcagagtgcagtggctctggacccagtcaccacgttgaacctggtcgctaccattgacaggccaggtcccttcgacaggttacgtaatttctctgtgcctcaaattccacctctgcgaatgacgagagggaggaataatggcccctgcctcaagggttattttaaagactaaatgagtgaatatacagagcacagtgcctggctggtattaagcattacatagtctttcaaaaaagctgggcagctggagaagtgaggcacggtctgcttttctcgggaccttctttggccacgttaatgcctcaccccaagctgcaaaaatatgcagcccaacccctgagggaggaggaatgtctaattcgtatttgttttggttgtgcatgtgctttgtttggctttcccagggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtaaggctctggggtgtcccctcctggttttgctggcagagccatccagtgaggccttgggggcacagctgggggctgaatgccactgcctaggtgtgggaaagtcaggcattttcccagctgtaaaacagaaattctatctggctttctgatcttctagaggcagtgtgggcatgaagagggatacacaaaacaccttgaatttttaagggggagaaaatctgcatccatgtgaagtagtttggggttctgtctcccccaagctaacctcttcctttaacacggagagcagctgtgcctgccgagacatgagtaccaaatccacaaaactgaattggccaacgtgatgccaagagacagaagccagaggcaacaagctacatgtcataggattggattgacatgaaatgtgcagaacaggcacatccttggaagcaggaaccagatcggtgatgccagggcatgggacaggagcagggagtgacggcagaggggccggagggatctccaggcaggatggagatgctctgaggctgcggtggagggtggtgtcatggctctgtaaacttaaaaaaaaaaatcaataagttgcgcacttaacatgggcgaattccatggcctgtaaattataccagggcgtaactgccagcattgcatcctcccgtggagagctctagccccagggcccggctgcttcccactgctggtttctctgactgacgccctccttctcacccaggtgtacttgggctgtgtgcttggtctggtggtcattttaacggggatctttgcttattaccaagaggcaaaaagcaccaacatcatgtccagcttcaataagatgatccctcaggtgagtggcagccacctatcctctggcctctggtgactcccaggtgaggaagcctcagctgggaggggcacagggccctgagggctacgggtttccacttccttccctgtcggagcaatcgtgggcgaattaacccatctgtcagaaccccagttcctcacaggattttgatggtcaaatgaggcaccacccagggcagtgctggttagcccaaggcatcttctgttcctgctcctcagtgtttgtggatagtccttctgggttctggaagggacctgtggaaggtcagggagtgttctttcactggcagccaaggagaccagcctgcaattgtttatctgtgaccatttttgctcctgagccccagaatgcatttggtggggaagcccagtgctcccttcttccccaaaaacccctgtcaggtgtccacactgtctctggcccagagaactgtgggctggagagattctgggtggaaaagacgcctcctgccaagcttgaagcaggagatcacctcgttaaaatttccctgacactcgcaagattatcagcctccccagccccaccttcagtgttctgcccagacgcccagccaggattgctcacccttagtggtctccttttctaggaggcccagggctctggcttggccagatctggccaacagcgactcttctgttccaagaactctccataagctcaagaaaaagtagttcttagagtcttcaggcctcgggtgaagcagtcttctgtttcattcttgctgttctgacagcctcatgctccagcagcaatgctgtgtccacagggccaggtgcaggctgcataacagcatggactcaacagtgagagtgatcaggaagttccaaggcctctgtcctggggttcggtgcggcacagacttgggggagggccggtgtccttccagggtctgaggcatctgtcatggtttttttctgcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtaagcggcaaggggtatccaccccaaggaccatgttccaaacctgctggctctggggtctttcccagcatcagtataagaggcagggaatgaggtacccagctgtgaaccaccttcaacatttcttctaggtggataactcatctctcacgggggagtctgagccccagccccgctcctctgagtttacccatgaaaaccccctggaaacaaagaacatctgcttctattccacaacgtgtctggaaggtaaaaggcctctggctctcagcccacatgtccacctgtgtcctttctccctcctgggctctcaggtctgtcctttgccacaccccgttacaaagctcatcccagaggaagcatggaactgaagggcctagaggacgatgcttggccttgggaatgtggtgtgcctatcgattgtgccagcccccagagagggctgcaagctggctgcacacccctcctggctgaggacccctggaataaagcatctacttcccctgtaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgagtccatgctgttagacagcctgcacctggccctgtggacacagcactggtgctggggaggcgcccacacaaactgcaatctcccccaagtccagagcaccacgccctccccgccagcgacaaccctggaacattctgcatagactgttccttacagagacaaaaaatttgtcatattttcaatatttgactgcgttttccttgaaaacgttatgctttcaatctgcaattcacacagcttactctgccccataagatctagataagacagactccaccattcacaggttttctagaagcttgatgccttccgcacatttctttggcagtttctacaacttaggcatttaggcacattgccacactccacttacctctcttacgaaaaaaaaaaattcctcccatttttcctgccgaggactccagccctttcctggccaaccccagacccagctgtttgtatgggcccatgtcattcagtccctagagaagagccccctcctcctcagtctctcctgtgggggtctcaaggggtaggagaggagggggtttatgtttccagttttgtgactacatgatcattggcctgctattgtcctgaccaaagaaaagagaagaagtttttgaagtccaggtctcctctgactccaggagatagtaatttggggaaattggagccaaaagaaccctttgagatctaggggtttaaaagaatctttaaaatatggagcttttaaaatgaaacaacataaaggctgctgaattccccaaagcaacaagtgtgtcctttgggacaactctttggcatgcactggtcagtctctcttacacactcctgcttagggatcacaggaggcgtcgtgattgtacgtgaacacgagccacagcagcgtgtccgtgtttgctgcccgtgggtcccttgttttcttcaagtcatgaaggaacaagaaaagcatctcatatttaatctttaaaaaaggattgtggcatagagggctcttggcggcgtataagccaccaggtcagcttagctgcgctgacaaccacacctctcccctaaaactagtccagctctctcctaaaattcaatcacagctcacattggctatttctgtattattggacctgagttcaaatgaggatttttcccaaagcgtccttccctctcctgctaggtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaagtaagtcttatggagagctcggtctggccaaagctgtggactccatcctggggctgagctgagcacacagcagggtctgcagccagaggattgctggacagtgactcatggacggccagcccaacccacagcagccactgttctttctctgtcttccagaccaagtctttgaccaaagctctaggacttgggcctccttatccaagataataacattgtgtaaccgagcagagttcaagccaggacaggaaaatgtccccatcatgaaggtaatgcttctgcagcacttggtcttaaatcacagccagtttgtagtcacttgctgaggtctgattgggtgcttgatttcatctctccagttgcttaaagtttgttcagtgcttgcaagagcaagtcagactcacaagacatccagaaatttttctttatgcacactagctttgagaatacaaagatgcttaaaaggtttcagaatattgctttagcgtcttcagaaaattctggaaatgaatgcacttctaagttactttcctgacttttctgccagctaagtggatataatcaaagttccttttaatatacacaccattcatggaaatttaaagtgtgattgaataaaaataaaaggactcctgttaactagaatatggctgcagacaaagctctaaggggtcctggaatatcggaacatacaataaactctccccctccctccctctcctccttcccttcctcccttttcctctccatctcaatgagtcactgaatccctgttctcctggcttttctatttgccatctgtttccttccctgactctttttctttcttatttttttgtttgtttgtttgcttttctctccgtcagacagctcatgaatgctctttttggccaattgcttctttgtcgatatcttccaaatctttatgtccagctctaatttcttacctcaactccaacccgaatctctggctggctgtgtgcttccgctaggaagttgcacaaatcatgcttgttaacttccacccgtacccagcctggctgcacatcagtgccttgccgcaattttctaattgtctatgatataaccattctatttgtcattggaacagaatatttggaagtcatctttgactttatcctttccttatatccagtaagccaccaagttctatcattcttgcttcaaaatatacataactttagtatttgtcagcagtaccttgcatctaaatagccgattaccggctgattggaattaaacctctttgattccggtttatccctcctggggtctttctcgaatgccactaatttcccttaatggtgcttttatagtcacttaactttgctcaaaatctctccgtacttccctgttttctgcttctcaagtctagacctcaggctacctttcagggccctccaggtcttgccacaccctccacatccgcttgtaccttgaacactcacggacgagcctgcccctcatgcccctgcacccgcatcctggtttctggaaggctttcttctctgtgtatcggtaacccacctatctatcaagatctagttcgtagctgcttttttccacgaaatcttcagtcctcgcagaggtccagcttctccaaacatccctaatgccagtaggtggcactgttgtttacacgcttaccacggtcttgcggccctccctgatcacgtgataatgtctctccagctaggtggtaatgggatcaggagggtgtgttttgggtcctatgctgagggcatgttggttcattaaatatgtgctgcaaatatttttcttctttgattcccagaaagctgtgattggagatgcctcagaaactgctcttttaaaattctcagaggtcattttgggtgatgtgatggaaattagaaaaagaaaccgcaaagtagctgaaatcccttttaactctactaataaatttcaggtgagtttttcctcacaaccggtaatctctgtcatcggcagcatgacctttctacttgcatgcatcctttgcttacctcatattttgaaggatacctggcttcaaagacagtcgtcagggatacagcacccaggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctctcacacacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggccttgttccatgttcgcatccggcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtgcggcacagttcaggccatgggagcaagccctgccctttggggagaccggtgagcagcccctggggtgacagccccgtcgttttctggggccagcccctgtgctgtgggtgggggtctcctttccatcccctgctcaggtagaagacggccttccttgcctggttatctcagcaagcagggctggccgacagtcagccatcacagcctccccatgttaagacaaatgacagttgggagccccaggtccccatgcagatgggattttccacagagcccacactggatctggacttgggctttgcacaacagtaaagtatagaaatggaataaccacaactgtacgtgtggagatttctggtgattatccacctgtcttagttcggatggaatttagggttagggaagaactcttttttttttttttttttttttttgagaaggagtttcactcttgtcacccaggctggaatgcagtggcacgatctcggctcactgcaacctccgcctcccaggtataagcaattctcttgcctcagcctcctgagtagctgggactacaggaatgcaccccctgcccagctaatttttttgtatttttagtagagacagggtttcaccttgttggctgggctggcctcgaactcctgacctccggtgatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactgttttaggatgagtattattatactaataatactagtgataataggagctattctgtgctaatttccacaagtattaaattattcattcgcacgacaacactgtggggtggctagaggatgaggaggttgaggtgccgcgcatcagtgcacagtgtgaagatggggttagatgatgcctccatcagcagcaggacttggagccctgctgaagctccatctcccaaggtaaaggcatgcccagttgcaaaagggagaaaaagcaggttccatgaggcctcatgtacaagttggaggagaaagtggctacacagagtgggactagaaaggggagaggggggccgggcgcggtggctcacgcctgtaatcccagcactttgggaggccgaggcgggtggatcatgaggtcaggagatcgagaccatcctggctaacaaggtgaaaccccgtctctactaaaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagaaaggggagaggggctgtgtgagttcctgctgaagaggtcggaggtgctgtctggatgctgttagggtcattttatatctacacatgagcggtgctcagcctcaccagggctttagatgtcatggccttggaaggagacgtctctgcgggaaggaaataaaatggaaagcctgtgtcttattgattagaatggtgatgccccaaacacactggtctgttaagacatttgaaacagtttacggcaaattggaaaatgttttataaagttttatataaagatgaatgtatttaatttaaaagattatcctttgtagccaccatgattaagggcagggactctggagcctgctagcctgggctcaaatcccagctcagccaccagatagccacctattgctcagtgaccctgagtgaagcattgaacctctgtgcctcagtttcctcctttgtaaaagggaataataatagtacccatggccttaaagttgttttgagaataaataagtcgatgtggacagcacttagaacagtgcctggcacgtggtacataccataaaagtgtttcatattatccctatgttttaaatgtaaaaagccttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttctgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacactccagcttcctgagattcctcttgagtgcttagaagagtacctggcttatcagaagggctagataagagttagtccttttattcttgtatatcgattttttttgcatatcttattaggatggatctagaagtagaattgctgggtcaagagcattcctattaaaatggagactcctgtgactcggctgtcttcctgaaacattatacgtggaagtgtccacttcctcacaccccgccattttctatgacatccaagcaggaaaactgggtggacaatgaggtgaggaggtgcagaaattcctgtcgcctcctcccctcctgagctcagaatagtttgggtctgaaagacggctgctccccacagggaggtagaggaggtgagatgcagaggctcgcagccccctaactctcacgggcaccctgggagatcttgttcaaggcacaagatttcacacgctgacggccacaactagcctgcctaaagcagccagttttgcttgaaagatgagctccacttatccagagtgggtgccccactctgggctggggccaagtctagagctcttcgtcttacttggccacagaaagaaaaagggcggaacatgctgaggatgccattgtgcctcttcctcctttacatttaatggaccagtagagaagaaggaatgcgtttcacctttctgtaagtaacacgctcagttcattccttcccagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtgagtgcggcggcagggccctgcccatcacctggtgggcacagagatgaggcaggcgccttgaggacctgtgacctagcccagtggccatggcatccacgtgaagcatgtaaaggagaacatgataagcaggatgggaacaaggagaggatgctgtgtgacagcaccaagcagggtgggatggcctccagagaggcaagctcagggaagactttatggaaggagttaaatttcaaactgggccttaagtgactgcatttgaggggagataggggaaagtatccagggcccagggaacagcacaggccaatcacagaggcagaacggcgtggggcacattgggtgctgccagcaggtgagatggcactgtcacagaaacagggttcaagggctggactggaggtcatgagatggaggtcttgaacatctgggtgaggagccaggtttcatcctgcagtcagtagagagcactgagggctgtgccactagagtgagctgggcagtcgcagggctggggaagactttatggaaggagttaaatttctttaacttctttaaatgtctttggcggcagcagggagaggagagatgcacatctccataggaagcagctgcccttgctcaggcaaaagggatgggaattttttcagggtgatgggaatgggaaggagagatcagggcaagagacttcatagaggtagagtttggtaagatttagaacctatcagagaaggataatgtttaaaaatgattaagcttcccatttaacgactaggaagagagtgatgccagtgatgcagacaaagtgtcaggaaggaaggaaccttagaaatgcaacaggaggaggacccaatgggggtgcctgcggtgttgtcaaaggggacagtgtgtcctgttgtcagcaccagggctggcggaatggtgccccatcaggaccacagaatgacaaattcaaggaaacagaagtgtatggttgacgatccggctcattaaacaccatggaagtcctcaccaatacagatgcagtctgtggaatgtgtgtttctaaaggctattggagttggcaaatcagataaagcatataaatgagatggtgatgctttaggcatccaataacccacagtaccgggtattctacacgggatcgatgcccacttgcgtttgatttctcaaagcctgctccattgacatttgcaaagcagtgggccaggctgaaaataaattggatgtgaaagctgatcacacaatcttggaggtcccaccagacacaagagtcccttccacctcagcctatgagaggctgatgccttctgagaaaaggatggctcggccccattcctgctggcctttctcttgggcttatcttgatctagcactgaactttgtgcccctccgctgaacccccttgttccttcacatgctgttttctctgctgaaaatggccttcccacctccaccctcccttttttccctagaaatcatctttgcccctctcaagcttcacctcacatgtgacctccttggggaagtctctcctaatcctccaggcagctgaaatgtgtctctgccctgagatgtaccctatgcttgatccctttaactctgtgccccgctaaacttcagaagtcgagactgtgtattgccctagaacttggcaatatagcaagatatatttctagaacacagagcctaatgagctcacagtgaattatatttggatgaaatatgtctttcctaaaaaaatgcattatggagttgaagaaattaaacaattctggcttattctaatgtattggtaaaacagcagaggaccaaggtgtatgagcatgttctcctcttattttttttcgtttcctattctagtttcactgactcactaattcatctgtattacaggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggtgggagttattttcctgactcaagaagttctttctttatgtcgtgttcctttctaataatggttttcatagcagatggtcagtatttaggtgtcttcaagtaaatatcataattcctattttatttctagtttcactgtgctaaggttactgaaactgtcccacaaaaagaaaatgattgtgtctatgtggaatgaaccacataaacagtaaatgcaatgagaagaatctcctagtgccttgaagtgaccatatctcgccctagtccatggtagatactaaaaggctttattggctgggcgcagtggctcatgcctgaaatcccagcactttgggaagctgaggcaggcggatcatctgaggtcaggagttccagaccagccatggccaacatggtgaaaccccgtttctactaaaaatacaaaaaaattagccagatgtggtggcacacacctgtaatcccagctactcgggaggctgaggcaggagaatctcttgaatccaggaggcagaggttgcagtgagccgagatcacaccattgcactccagcttgggcaacaagagtgaaactctgtctcaaaaaaaaaaaaaaaaaaagaaagaaagaaaagaaaagaaaaaaagaaagaaaaaaggctttattactcagtcttgaggctcagcccccataatccatgttcatcattactaggttaatattaagactgttgaagtaacatggggctacccccaagtagacactcaccagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcccagggcactacagagtaggtattactgaaccatccccactttggccaaccgagttcttcattacccgtgggccttctcgttgtctttgctctaggttattatggttactggtgatcatcccatcacagccaaagctattgccaagagtgtggggatcatttcagccaacagtgaaacagtggaagacattgcacatcgcctcaacattgctgtggagcaagttaacaaacggtaagcacaggagcagcatagtaaaaattccagtttatacccatggggccccactggctctaaagagctgcactacttggaacaaatcagctttttgctctcagagttatgctaggcttgtttgagctattatttgcatatccatgtattcactctaatttcactgagcagctaatatgtgccaggcacagtattgataccatgaaatgaccctttatgtgttccttgtttgaaatttcaaaatccagtgtgccctgggcacaaaacctatgtgcccaatttagaataagaaaaactgaaacaaagggtttatgtgaaattacttgccatagatgcagttgcataatttggaatcgtaagaaccctgtgggttgtttcatgcaccctccttggtaagcatcttgggtatttatccacccggtttcataacgtgtagctatgtaaacacacccttcttttttatttggtaatagatagaatggaagcttcctaaggaaagtttttttccttgtttctcctaattcttttaatcatgtttatccttattcttttaatcatgttcatccaactgtacattcactcatgtatttgttctttcaacaagtatttactgcgtgccaactatataccaggcaagacctggaactacagtagcaaactgaacaatactatccacaccgttggggaatctttccatcgagccaaggagacacaaacaaagctaacaatgatgtggccagtgtaatgagggagccacacaaggctagggagctgggcatgcaggagagtggcctggactgtgcctggtctccatgagtcaaagactccgaattctcaggttgagaagtaatgttcattagctgggttatgttttcacgcatgcgggagatgagggaaagaccaatgcacctcttcagtttccccaagcacttaggtcttttagggacacacagctgtcaggtcataacaaattaccacgttagacaaccaaccagggttcccgcctctgggcacagcagcagtacctgaagtctaagagtcttgcagtgccctttagtatacataacatccctctatgaaaacaactttggggcttgtttatttgtttggttttgtaagataatcggattatactttttttcactttagaattttaaacaaattttgtttgtttgtttgtttgtttatttagacagagtctctctctgtcacccacgctgtaatgcagtggtgtgatctcagctcactgcaatctccacctcctgggttcaagcgattctcctgcctcagcctcctgaatagctgggattacaggcgcccgccaccatgcctggctaattttgtatttttagtagagacggggctttgccatgttggccaggctggtctcaaactcctgacctcaagtgatccacccaccttagcctcccaaagtgctgggcttacaggcgtgagccaccacacctggactaaaagaaatttttttaagagtagtcaagtgcagtagtgagaagaggggaaagagtagaagtttgatctgtaactgactgtgaacaatcagttgagctaattcactactaccttcagaccagccgagtcttctttttttagatacaaggtgtcctgtcagatcacccaggctggagtgcaatggtgtgatcatagctcactgcagcctcgacctcctgggttcaagggatcctcccctctcagcctcccaagtagctgggactacaggcttgtgtcactgcacccagcttcattttagcagatttttttttttttgagatggagtctttctctgttgcctaggctggagtgtggagtgcagtggtgaaatctcattgcagcctccacctcctgggttcaagggatcctcccctctcagcctcccaagtagctgggactttaatttaaaattttagcagatttttttttttttgagatggagtctttctctgttgcctaggctggagtgtggagtgcagtggtgaaatctcattgcagcctccacctcctgggttcaagcaattctcctgcctcagcctcctgagtagctggggttacaggcatgtgccaccacacccggctagtttttgtacttttagtagagacggggtttcacgatgttggccaggctggtctttaactcctgactgcaagggttctgctcgccttggcttcccagagtgtagagattacaggcgtaagccactgcgcctggcccattttagcaatttttaatgaaagttgtatataagataccttattcctgcatcttctcaattgcttcttttttatatttgcccttccttccctacttaggaagatttgtttggccttccattcaaggatcttttgtggtctttgtctagttttagcctggtgatggccatgtgctggtgacgtgcacacgacggtcctgcccttagcctcctcctgtgctcctgttcagtataggtggcacatttcttcctataaacctggactgctttgccaatttgctggcccgtatagtgtctttgtgcaacctcaacttcctcatcctttcagatgggcatggatggaactgtgcttgtagcagactccagaatgtgcttctgtctcagctctttggaacgagagaaagacataatcttcctacgaatgtgggaaggtgcattgaaatgacttttatgattcttgcctcagtcaaaagtcacaaagggactgcacttcctcttggtcactgccactctgctcatggccacaaaagggaagagtggattacacatttgtatacaaatcaccacactgagtgaagtggatgcttttgtgaatgttttcagttattcacttcatcagctctagtttcatgaccatataaaaattgcatcttagcaggtgtaaggggaaaggaaacaccccttctttcttctcttactttcttttgttttgttttgttttgtttttttgccagcggttaaggagacctgtagtttgagtcaagtgctagaattccagtatttagcaccaagaggtaaaacagacctagaaagctcaaaacttgcaaattgtaaagaaaaagacctgcagcagtttgtacctacattgtttaagctgagatttgaaggctgaaatgtagtgttagccacgagaagctgaggtgagagatgcccattcctggtcagggagcgagacccgtgaaggccttagggtacaggggatggaggatgtcagaactgagagcatccagcgggcaggagggagagcccaaggtgaggcgaagcttgacaacgcaggccccacctgggctcgctggctaaagttagggattccggggtctgctccaagcacggtggaaagcccctgaagagttttagcaggggactggctcaggcagctctgcataatcaataggccctagaaccttacttttatagtcagcaggcaatagcgctgctcaaagacttcagtaaacttctgcctacgtagcacattgcacaaagatgacactctgtaaatctgaaatacccaacggcaagtaattattaccccttgtttggccataaaagaattctaggacccaaaacatatgaacaggcagtttgggggttttatttttatttttgtttttgagacagggtctcactttgtcacccaggcttgagtgtagtggcatgatcatggctcactgcagcctcaaccccccaggctcaagcaatcctcctgcctcagcctgctgagtagctgggaccacaggcacatgccaccatacctggctaattttttaaaattttttgtagagacaggggctctcactatgttgcccaggctggtcttgaactcttggcctcaagtgatcctcctactcagcctcccacagtgctgggattacaggcatgagccactgcgtttggccatgaatgggcagttttttaacttccttttacttctgaagtaaagcgttgctctaggaagtaccactctcacctgttctagtagggataaggctacctggttttttattcctattgttatatggtaccaagaaatggtgttatattttagcctcagtttgccctcttgaaatggagactaaagtgttcccaggactcctgttacctcactagagcattaggtatcaaggacactgggttccaggtcaagtcagagaggcttcagccagcatcctgcctggaacagtgtttcaacctaagatctgcccttgggcctcacccagtttcttctggcccttctagggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggtgggtggacagcagtgtccagaggactgacaggcccatcactgtccatgggcaagtgcagaggtctggatctcacatcaggctgtggtgcctttgaaacttcaagagagagttcttggctcatccccatcacctgacctctccaacctctcaggtgggctggcccctgtcctcctttgagacccccaccacatgttccccgaaaggctcaccccagctctctgcattttgtcatgagagcccggtgaagcatttgccactgtggtagttgtgagtaaagagagatttaaaatgcaaagatttaaaacaaaaaatgtgaagacataagatacaagacacctgcgcattaggttttcctcatttgcacgtatcttgtttggagacccttgttcctgcttctaagatttctcatctttatcttttcccctaaatgggcctttccgttcagctataatcatcctcgcaacctcaagagaaagggaagtcttgttgctcttgccaggcctgcaacccactgggcctgctcactcccactttctccctgggtcccccgccataggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtgagtgagtctcagggggtcttcccaagggccagggtggtctgggggactagaagtaagttctgaaggagaaacctctctgcctaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattgtaagtgacactgaagggaacaggctgtgatgcctgccccaggggaggtcaagttcagggtcgctaccttcaagggccggggatggactaactcaaggcttctcagcttccatgtgatggggcctgtagctctgcatttctcacaggttctcaggtggtgcccattctaccagtccacatgccacacctcaaagcaagggaccagaggcatctgccaaatgtttggaaattaaaaacactctatagtgagcttttttttcttgagacagagtttcactcccatcacctaggctagagtgcagtggtgctatcttgcctcactgcaacctccgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtcagtttcagcctatgggcttcccttttcttttgggaagatgaagctgtcactcagattaatcacccaaataaccactgggggcccagtgactaaagtgataatctcacagccacctcttgttaagtaagagagtctgacatggaagacctttacctaaacacagtaagaagtagcagttatgaagactttataaagccttgccctacagtaatgtcacctaaaccttccccttttccagtatccatttaaagaaagccccgtctaagctgcccatgtggctgtggcttacgtgggcaagcagggaaagcaacagacagcaagctgaattcttagcaggaaactggcccttcgaagtgcccccttccccttcaaattgcccccttcccctctcttgttttctacaacacccaggtaatccctaattcctagagagactggagatgtctttccctttgaggggtattgaggtccccaaagttgatggatcattttccaagcccttcacatttgcctgctttgctctgctgcagtgcttctccaggcctggtgcgggcatcacctgggaacttgttagacatgcacactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggccagctccatgccccccaccccatccagccagtgccccacccaccccagcccccctcccctactgtgggtagagcagaacatcctggggttagacctcaccagcctcttcccctctagatcccctccattgccttggcgtacgagaaagctgaaagtgacatcatgaacaggaagcctcgccacaagaataaggacaggctggtgaaccagccgctcgctgtgtactcatacctgcacattggtacgatgagggcgcgtcttccccatcacacgagggcctgccccgagaattcactggagtggggggcacagccagaaagtgtggttttcctgtggggcctgggttggggagggagggggaaccgagagtagacaggatgaggcagtttcctgaggccatcatagaacctgtgtcctatctctcttgttctttcaggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatgggtgagtggcgggagccctgctgcagagtccacctgattctctccatgctcattgccctgcgcagaattacatagaacctccatgtccctgaacagcctgggaaagcttcaattaatagggctcagggcccccttgctgacacgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggagtttgagaccagcctggccaacacagtgagaccctgcctgtgttagaaataatagtaatgataattttttaaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctacacggctttctttgttggcatcctagtccagcaaatagcagatctgatcatcaggaaaacccggaggaattccatcttccagcagggtctcttcaggtactgcctgtgcccggcctcctggggcagccctgggcctgccgtgcaaggatgatgatgatttgtttttcacaagacagagttctggccacacttgtaaccccagaggcattgatttttctggtggcatggtctgctgggtgtatgatcatgaagccacaagaatcccaagtctgtctgcttttgtgtgtcttgcagaaataaagtcatctgggtggggatcacctcacagatcatcattggtctgatcctctcctatggcctcggaagtgtcacagccttgagtttcaccatgcttaggtgagttcaccctcaacagcatggaggaaagagccagcctctgctttgagctgtcgcagcctaaataaacctgaggattcccagggttcttccccaagtctttcaaaagacgtcaaactgatcccatgctctgtgagcccaaagctttgatctgcattttccagaagtggaaatgggttttctagacctcaccaaccggccttcatcctcatccaacaggttgcttcaaaggcagacattgcttctagcagtcacagtgcaggttaaacaaggagctttccacctttattttgtgggacctcgtggatttgtcgttctttgcagtaaagcaagacaaatgaacgagaagccccattcccattgggcagggttgggctatccctgtggatgagtcagggttcactttccatccctttgcttccagggctcagtactggtttgtggctgtgccgcacgccatcctgatctgggtgtatgatgaggtgcggaagctcttcatcaggctctaccctggaagtgagtagcctatgattttagaggctctgtttacccacttcaacagactctccatttctgatgtacttttttctacctctacaggctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtatagggaa

SEQ ID NO: 2243 - DNA, 31376 bp, Homo sapiens; identical to SEQ ID NO: 2242

SEQ ID NO: 2244 - DNA, 48671 bp, Homo sapiens
cccgccccggtccgcaaagccggtggcgcccggaggctgcacggagagcggtgcccgcgtcaggtgaggcgcgcgcggggaacgggggtcgcgcgcaggggagcgggggtcgcgcgcggcttccatagagcgctagggcctgagctcgaagccccaggcccgcaggaggcccgggcccgcggccgccagagccgggacgcagcctgggcgccgcctgccccgccccgccccgcccgggcccggagtgaggacgcggtcggaggcccagcagcgcgggtcccggcaaggggctttctcaactacacaaaagacagtctaaaaaattaagtctccatttcggttaagactgcccgtagtttcggtttttatgtagacccaagagggcaggctcggcgtccgcgtgccgcgtagtccggcggctccaggagcgcgagcggctgggcccgggcgtagccaccgcagggccgctagctcggccgggacccgcctgggatgccctggggtctgctccgctggggcgaatcctgaggcgccacgcgaggcacttggcctctcctagccccgctttcgtttttggaaactggaaactatcacttatttcgtagacggtgtgagggttacatgacagtgttctgtaaagtgcactctacatatgaagtgctcagaaatatggctaataatgagggtatttataaactacttaaattataaaaagaatgagacatcagacttacagttttggatactaatttttttcacttaacgttcattatgtgataggagttttccatcctattataccgctgtgcgatctgatcttgggcacgttaaccaacctcttgttgcctcgattttctcacctgtaaaagtgggggtaatcataatgcttacttagtaggatagccctgaagaataagtgacttagcgaacataaatagcttacaatagggttttcagcatgggaaggattcagtaaatgttagctgtcatcatcaccacctacaaaggaagcaatactgtgctgaaagtttttccatcattaatgtaatttctatagtacgattcccaagaagatattaaaattatggaaataaaggtattggtatattcctaattatttcctaaaagattgtattgataaatatgctcatccttcccttaacgggatgcattccagaaaaacaagtcaaatgttagacaaagtatcagaagggaaattctgtagccagagagctaaaaattacaatagggtctctaattatacttcaacttttttaggaataattctcagtgtgttttcccacatttcatatgtaatttttttttttttttttttttgagacagagcctcgccctgtcaccaggctggagtacagtggcgcgatctcggctcactgcaacttccacctgctgggttcaagcaattcttctgacctcaggtgatccacccgcctcggcctcccaaagtgctgggattataacaggcgtggcatgagtcaccgcgcccggccgatctttacttttttattctttgtaccccctgcctatccagttagcatgtgattaaagtcaaagatttgccactttgggccacatctattaattttcatctttgttataattgtatttagtttttgatctacactgcttattactcccagtcattttttctagaactgaaaatctggtaaaatactcaaaattgcactgacttctatgtagaggcgacactccatcagaaccgtgggctgacagggaatcccactgtgcaggagctgcgcgcattttcatttctgattctctttggcgtatccaggactctgatgacatgatcatatatttatcagtagtaacaggttgggccatttgttttttgtggtaaatcatatatttaagattttagaaataagttgatagccatgtattttggaatttgaaaaagacattgcattactcagcttcaaattaagctttaatcaaatagtgaaactttccattaatggacagtgtatacctttttgtgtatttaaaaaaaaaaacactgaatatagtgcctttgtgacaggggagcttagttcctgacaatgtcctcttgagtcttttttttttttttttgagatggagtctcactgtgtcgcccaggctggagtgcagtggcgccatcttggctcactgcaacctccgccccctgggttcaagtgattctcattcctcagcttcctaagtagctgggattacaggcacgcaccaccatgaccagctaatttttatacttttagtagagacagggttttgccatgttggctaggttggtctcgaactcctgacctcaagtaatccacccaccatggcctccccaaagtgctgggattacaggcgtgagccatttcacccggcctctcttccgtctttgagctgtgaggaaatagctacattacatgagctgctagatctgccttatggtcagaaatgaaggttgaactctcaggaacagtgacatatatacacactgatatttccaaagtacaatgccccaaattgatccacaaaggaattaaggtcatttgcaacaaaatcacagaatagtaacaaataaatagaagataaatatggccaggaattgagatgagagaaagtataagtacaagaaactattccaggggaaaaaaagaatgaagtgtttcagtgttatccaatagaattttctgtgattatgaaaatgtgctatatttaattaatttatattccaatagccactctgtgtagcggctcccttataggtcattgcaggcctatatttttgtagttgagtcccaaatttgtttctagaaaggtaaacttggtcagttacatggttcttgtcttttgaaagtaaaacatacatggcaacttcattcattcattcattcattgatcccccaaatgttaatggccttgaaggaagcagagcctttcctgattctcagttatagggaaaattttctgtggacttcattatcagagcaccttgatatgttattgccctgtgaaagtctgttcagtttggggctaggagggatgcagtcagtgaaagtggcatagtttgtaatgttttttagagttttgaataattatgttaactaatctttatagaaaagtttaaagtgtacagagaagcaaaaagaaagtagtcactaaaagtttcaccacttagagacataattactggtaatattttgatgtatatatttccagacttgtgtcccatgtagctattatatttttctcaatagatcccaaagtatccaactccctccagggcaagagttgcttttacctttacccttagacctctgaggctggcagctggccccacctgagagggtcaccctctccctaatccttccccatacttctgtgagtcacctggctttggggcaataatagatacttgagagggcgtttgaggaggaacaaggaggaaggtcacagctgtagttcattctgcatgatgtgtaatccaggctttttcaactctggcactgttgacattttgggctggataattctttgtgtatgtgtagttggggtaggaaggtgtcctgtgcatcacaggatgttttgcagcatccctggcctttccctactagatgccaatggcacatacccttttccccccgagtacaacaatcagaaatgttggtgagaaatactgggttaatgaaaatcactaatttattgctgacaaagctctggagtttcagattccaatttgcatgtgggaaagagactgaaatcaaaagggaaacataatgtaagccaaggaagctgtttagtcctggctgtgctattaatttactgtgagattttgcatctctcccacgtgcaaattggaatgtgaaactctagagctttgtcagcaataatttagtgatttccatgaacccagtagttcctttttttttttttttttttttttaagatggagtcttgctctgtcacccaggctggagtgcagtgggacggtctcggctcattgcaacctccgcctcccaggttcgagcaattctcctgcctcagcctcccgagtagctgggactacaggtgcacgccaccatacccaggtaatttttgtatttttagtagacatggggtttcaccatgttggccaggatggtctcgatctcttgacctcatgatcagccccatgcccgcctcggcctcccaaagtgctgggattacaggcatgagccaccgtgcccggcccttaacccagtagttgttactgacatttctgattgtcgtgctggggggaaaacggtatgtgccactggcatctagtggggaaaggccagggatgctgcaaactgatatactgccaagtttatcagttgggaatcccaacagtgaaaagcataaaaatgaaaggaattttaaggagactttttatagaagagtgggcaggattggaggagccaacaagtgatggtgaggcacacagggaagagcttcagtgggcaccatcccctctctggtttgaaggggtagggaggggaccagagctgggaggagggggctggaatactgctggaggagccactcccttccagacctgctgtggccatcacagaatgcagccactgccagagcagcagcctgaggaaccaggcagggggagcacaagtaccctagcctctctctttctgtttcttgcctgccgatctcctccactggctaaacccagctggatgctaagagtacagtcagcctgcctgctgaggagggaccaccagggaccaccatcagcaagggatccaatgtctttctgcctctgcagaatgaaggttggggcacggggggcgctctacttcttagggatattgtgggaataaaaggaaataggcaaaaaatgtttttgaaaaacaaagcacatactgcgcacccgtgggccactactgcttttgacccctggctctgtttcatgaagtaatgtcgtgtcattctctttttaggtgctacaggatttctttaggtttgttttctgtccaccatatttcaactcatgtgtgctgtttgttgtgctaaaacaaatatttgctgatgcctgagtgaatagttgaatattttatataagtcaaatttatacgtaatgatttttcttgtaacttagccgtttctcttttacaaactcagaaaacctcagactttgaaaaggccttgaagttcctcacctgaaatctgagaacttggagcgccttaaaaaatctaaaggaaaacaaaacagtgaaagaacatgatatagtcagtgtagagaataaaattatttatgtaattaatattgaggatgcagataacacgttgtgaaatcttgcttgtaaaaaatctcgatctgctgaagaaagatgttctctctagagatctttgaaagcataattattgagcttttaaaatgttagaaacaaaagttagacccacacatattctggcgtgtggaagatttgcattccttcccctgcccgccccgcccccgcacttgtgagttgtgcctgtgtacgcagttcctgtagcactcggctgggcagaaatcatctttcagcactaagggaacatagttatgatctggaccttctgggagtggtcagtgcccaagaacaggtatgggactccagaaagttctgctctcaaccctattttgaaatagagttacacattgttctacaattatttgagttaataagcagctcttttcaaacgtgattatgcccttccaagtttaaatacactagactttagtgaaagtaattgacctcatctcatttctctcctgttatattaagatcactttcagtaaaaggtagaagcttttgaagtggtgaggaggaggtagaggagggacatagagcagataggggctggaaagtggggtggggaagagagtggcttctctttggcagagtaccaaggaaaagccctatctgtacagaacctttgtgcctgggaacttgatggctgcaacctgagcctcaacctagtttgcttgcggagccagaagagaagctaaaaaccttcagttaaccaagccagacaccaagaaagttaaaccgaaagagaaccccccaccccccgcaaaaaaaagaagtaaagtgggttaaagtgatatgttagcacagaaagagaacataagggtcatctaagttcatctgccccctcttctatttcaaggtgcagaaactaaggcacaagggaccccgtgtcctgctcttgatcacatagctagtgggtgccaagccaggtctagaactctgttctctggggtcacaggctggctcttcatccctctagagagatagctcatctgtgtgcacctgagcccgttgtgtttcggagtcaaagcaaataaaggctcaaactccaagactgttttgcagaccggctgcagtagatacggggggaggagaaacctgctttaaattgcttcaagcaagttgtttctgcaaaggtgttgacttttttctttcaactttctagtgagtcactgcagcctgagctgttatttgtcattatgcaataattcaggaactaactcaagattcttctttttaaattatttgtttatttagagacagagtcttgctctgttgcccaagctggagtgcagtggtgtgatctcggctcactgcaacctctgcctcctgggttcaagcaattctcatgtctcagcctcccgaatagctggtattacaggctcgtgccaccaccccctgctaatttttgtaattttagtagagacacggtttcaccatgttggccaggctcgtcttgaactcctggcctcaagtgatccgcccgcctcggcctcccaaagtgctaggattacagccgtgagcctccacacccggcctatttatttatttttaaattggctgctcttagaaaggcataccatgtttctggatgggaaggcttattaattcaccctaatttaatgtataaatttgatgcaatcatagtcacagtcccagtggaattttttaacttggtaagatgttctaaaattaatgagagaacttgaattaccaggtattgaaacactgtaaagccacaatcatgtaaacagtatgttataaccatgggaatagaggtctgtgatacagcagaaaaaagtgaaaaaaagaataactgtattcataaaaatttaaatgtggagtcactgggggaaaggattaaatattcgataatgtagaaacaactcaactatttggagaaatgtaaatttagagccttatctcatgccatataccaaaatactatttagatttgattaaaaaataaaaatgtaaataaagaaaagttaaggcaaggcgtggtagctcatgcctgtaatcccagcattttgggaggccgaggtgggtggatcacctgaggtgaggagttccagaccagcctggccaacatggcgaaaccccatttctactaaaaataattagcgtggtggtgtggtggtaggcgcctgtaatcccagctactcaggaggctgaggtgggagaatggcttgaacctgggaggcagaggttgcagtgagccgagatcccaccattgcactccagcctgagtgacaagagtgaaactctgtctcagggaaaaaaaaaaaaaaaaaagttaaaaatctaaaagaaaataaaaatgtatctatttaatataagtcttttgggaaaatatttctcagcataatactaaaagttagaaaatagaatgtttttgtgtttgaccatttaaatagtacacctttgaaatttaaataaaaaaaggaaaactaaacaaaccaaaacctttttgttacaggattaggtcttagatattttaagatatattaaaatacagaataaagttcctccttgattctgttcagagtttaactagtcctggccagacaatggggaggaaaggagagggagctgtgtgatgggcaggcagagagttggaaggtggagccagatctcgcttggcctgggattgctgcctctcctgacggtgcatcttatcgtaagggggagttgaaagcagaaggggaaacagcacagaaaggatctgtctggccgttacagttatgtgaccatggcaggtcctgccagtcactcacagctctgtgagcaactagctggggtaccccagctgaatgtgctttaaaaacagcaatgtggccaggtgcagtggctcatgcctgcagtctcagaactttgggaggccgaggcaggaggatcacttgaacccaggagttcgacgttgcagtgagctgtgatcatgcgtgccactgcattccagtctgtgttaaagaacaaaaccctgaccctgaaaaataaacaaataaacagcaatgccacttattctaggtggtacacccctgatgcccagtgtacgagttccatttaggcttctttctcgtgcatatgcatctctccacatcctttcgtttgtttgttttcttttgttttgctttccccagattatgtaggaaaacaataaagttcataagtaatgttctgtaggccacttttataggaaaactttcctctaagatctcattagaaaagaaaagcaagtagcctgccaccgagcacctgtgccagcacaactacactgtggagcacccagataaagtggcgctgaacgcactgcagcctcctaagttcggaaaagaaagctcattagcatctacactgaagacgctcctgttcttcacagctttaatgatcactgttcctatcgggttatttatatttcacaactaaatcttatatatctggaggcgcccttgggatatccaataaggacagctgtttttatgctgctattgttgccgtggtcaccggccatgtggtgctggccctctttatgtatgtggtctggaatgaaggctcatgacagtgacatgaaggcaaacaggattaaagtgaacatcaccttttgatagcattaaattcattttttaaaatgataaatgctggaggggggacatctgatttgaataaaattgaaagaacatgttaaagtcagtcttaaggagtcatgtttgagtagtgtaaattttgatcctcctaatatgttgtttgtatattcagttttaactatatgaatctcatttgcaaatgagaatttggaaaagttaaattagttacaaatagatatgttaattacaaaaaaaaaagaaagggagagcaagtagtagtgagatttctgcaaggtcaaaggactcagggcagtttcttctgaatgtagtttgggggctggagaaagaaataggaagcagtagaattgctaggtcagattggaattttaagagctattgctgcactaccctccacagagatgctacccacttgtagtcccccaataatatcagagtgtattcctgaccacactttaaccaacacactctggcaaacattttgatctgtcagtcagataggccttcttgctataatcagaatttacattctgtgatcatgactgagggtatcattctgcctgttataagagttacctgaatttccttttctgggaaccagagagcaatttagagctggagcagaccttggagatgaagtccaaccattcagcctacagcctatgacccgtttgaccgtcgttgttgcttgggtagttcaggactgacaggactggacaccaggtctcctgtttatccttgaagctctctgggtgaatgtaagacaggacctgtcaaggcctctggcacagcctgggtttgagtctagaaccagaaagtctggaaattgcagggcagtgccgcagtgccttggctgtgaagcagggtgctttaccctccctgaactccaggcacttcgtctgtaaaatggaattaatactagcttttttttttgccagggttctgaggattagggttaatgtgtatgaactagctgacccagagaggctcacatctgttctcatcctcctcacatttgggtgttctgttatctgttatctgttctgtcactgttctgttatctgactatcactcacgtgcaagctccaagggagacttgaatgaaagttcttaaaaacagaagtaaagcacagtagggtgttggggagggcatctctgtggggcctccaggtagccaggggagggcgagcagagtgtgcttgctggggaccctctgctcccgtgtcttcatgcaccctcctacttagagtgctggcgctcccaccccacccaccacctgcgggtcagctctcagtgtcttagttatccttctgagattttttttttttttaaatgagacagggtctctcatctgggtacaaaatagtttggggaaaaaagagataaggtctctgtcaccctgtgagtgacagaggtgacgacatgtgagatagtgactcatgtcactatcactctaggctggagtgcagtggcgtgatcatagctcactgcagcctcaaattcctgggctcaagtaatcctcctgccccagcctcccaagtagctaggactataggtgtatgccacaatgcctggctaattttttaattttttaagtaaagacagggtcttgccatgttgcccaagctggtctcggactcctgggctcaagcaatcctcccacctcagcctcccacagtgctgggattacaggtgtgagctaccgtgcccggcctttctgagatattttatgcataaaaagacatcacacctatactgcctccccaggatctgagaagaaagtccactttctttgtcacattctgctttttggagtttttcttctagtaggttccctttttcagatttttttcagatgtgaaaaggctccagactgcaaaaggaaaggcatcatgtgtgctggccaggttgggtcatgagacccactctcaaagcaggaaggagcaatgggaagagagaagggaggggagttgccgaaagcaggctattttctttttttttttttctttgagacagagtctcactctgtcgcccagtctgggagtgcagtggctcgatcttggctcactgcagcctcctcctcccaggttcaagcaattcttctgcctcagcctcccgagtaggtgggaattacaggcatgcgccaccacacccggctaatttttgtatttttagtagagacggggtttcgccatgttagccaggctggcctggaactcctgacctcaggtgatctgccttccttgtcctcccaaagtactgggattacaggcgtgagccactgcgcccagctccaaaagcaggctattttcaacacaaagcctacacgatcacccatgcccccttccccgggtagtcttaaggttgccaaggtcggttttgtttgttttggaatgggggtggttatttcactgtcattcatggttctcatccctgtgcttaaccaaagagaatgagatcaaatgctgtgctgggtccaagggcaggggttgccacagccttcccttttcagaggccttctgccctctgcaagctaggagtggtcatcgtcatcggcttcctggacagcctatgcaggtggaggggctggagaggcatctgtagtgcatttttcatcacctctggttatccatttgcctgacctttcctgcccagttttagttaaaatacagtggtgattctagtggctctaacaagtgagagaaaaaattaatctttacaggcctctgttctactgtcattccagtgtttgtccaggtgtggctcctgaccgtctgtgtgcctttacctggatgcttggtgaaaatgcagattcatggcctcccctccactcttggccttccaaatcagaatctgggagtgaaacccagaaatatgcattttcaacaagaatcctaggggtacattaaagttgaggacccctgttaagccgtgttgttgctttcttttccttcactctctggtctcccctcatctcctcttgtcacccctccttccttgctacccctgctcacctgtttgccccctccttcgtcttaatgctgagggtccggagcggcttcttggactattctttgaacatactaaattgcagtcctccagaaactcagctaggaagaaaaaaaagtacatatttcttattgccttgcttgtccccatttaaaaagccagataaaaaactgtcctcttcaagcaccagttttgggaagtgcatccttcccatggaggcatcccgattgcagctgctcttccaatgtaggagacggatctgggcttggaaatgcccttctctaaggaagcattgctggtgtgacatcccagggaagtcagctaccaccagccccaaagtagacactggcctgggtatcctagctggaaggcacaggtggtgaaggcatttgggaaacatgagaatgatgggacaggaagcagtgggggagcatggggtggcaaaggggaatgtttgcctggagtttgggcaggtgccaccagggacctgaacctctgcttttgtctttacagtgaccgaaggaagagaccaagatgaatgcagaggtgagttctttacaaagaccagtttaagggatgcttttcttattgtgtccctcatttctcctttgcagagtctccattccctttcagaaacatcagcacaaacttgagaacatttcccctctagcctactgaagtgcacgtggttctgggtgatgcaggaagaactaggcccctctgagttcttatctgtgtctgtctggcttcattcgaacttacccactgcagctaatcctgaaacaacactccctagctctggctagtagtggggcatggaggttgctgggcccagatccctgctttgtgttattctggaaacactttctctgcattgtctccttggtgctctcacttccagttctttgatgcatggagatgtctagctccttatccttttgttttttccttttgttttacccatcagccccttcctctgttcactcccttccaagtggagcctagaccttggggttcatcacttcagccactgctgtgctgacgcccactatgcttttcccacttgtcctgtccatccacatggcaaacacagaggccatccccacaagaggggggtcttgggtgagtggcacagccttgtgctgtttgcagctggcagatgtctcaacacccttatctggtgctcagcaccacccgccaggccccctgtcactctaggcagctccttgccagtgccctgaacccccagctccaggcttcatccctctccctaagctctgtcctcctcgaaggtccccctcactcttagcatcaggatcccttttcattttacagaggaaaatgtaaacattccatctgacatcatctccctcaattcctgcctctccatttgtcctgttcctcctgtcacagtgcaagggatgtttgtcagtgagaaagttccaggttgtgaacaccagaaagcctgacttaatgtggctttttcctggaagtccaggtgaagggcaggcttcagggctggtcgatcctgcggctcagtgactgcctcaaggatccaggagcttttcatctctctgctctccatccagctgttggttgcatcctagggcaggtgcccatgtggcagcaagatggctgcagtggcagttggggccacatatgttcgcattccctttcatcagcaggaagaagtggcttcctgcaactccttcaggggagtgggagcctttatttgaagccccatcaaatgtctccttcggtcttattggccagaatcaggtcctggaccatagtgtgtctgaggagcagggattttgtgattggcttcaactactcaggcccatcctggagcagcttcccccctgccccagggctgggtgtggaaagaagaaagggggatgtatccctgtctggtatgagacattcctggtccattttcatgctgctataaagaactgcccaagactgggtaatttaaaaaggaaagaggtttaattgactcacagttcagcatggctggggaggcctcaggaaacaacaattatggtggaaggcaaagggaaagcaaggcaccttcttcacaaggtggcaagaaggcaaagtgctgagcgaagggggaagacccccttataaaaccatcagatctcgtgagaactcactatcatgagaacggcatgggggaaaccacccccgtgattcagttacctccacctggctcctcccttgacacacagggattatggggattacaattcaagatgagatttgggtggggacacaaagtataaccatatcacctagtgacggtatacccttctcctctgaaactgcacactcctgcctgctcagaccttgcaccacctccttagttatctcctttgccatgtgcatcattaacctaattcccactacctctttctcatcgatatttcaaaatgctttcttcagaacaaaatgacacctcacatcttgtccagcaactgttatcctatctttctttttttaatttaattttattttattattattatactttaagttttagggtacatgtgcataatgtgcaggttagttacatatgtatacatgtgccatgttggtgtactgcactcattaacttgtcatttaacattaggtatatctcctaatgctatccctcccctctccccccaccccacaacagtccccggagttcgatgttccccttcctgtgtccatgtgttctcattgttcaattcccacctatcagtgagaacatgcggtgtttggttttttgtccttgcgatagcttgctgagaatgatgatttccagtttcatccatgtccctacaaaggacatgaactcatcattttttatggctgcatagtattccatggtgtatatgtgccacattttcttaatccagtctatcattgatggacatttgggttggttccaagtctttgcttttgtgaatagtgccgcaataaacatacgtgtgcatgtgtctttatagcagcatgatttatagtcctttgggtatatacccagtaatgggatggctgggtcaaatggtatttccagttctagatccctgaggaatcgccacactgacttccacaagggttgaactagtttacagtcacaccaacagtgtaaaagtgttcttgtttctccacatcctctccagcacctgttgtttcctgactttttaatgatcaccattctaactggtgtgagatggcatcttattgtggttttgatttgcatttctctgatggccagtgatgatgagcactttttcatgtgttttttggctacataaatgtcttcttttgagaagtgtctattcatatccttcgcccactttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtccattttggcttttgttgccattgcttttggtgttttagacatgaagtccttgcccatgcctatgtcctgaatggtattgcctaggttttcttctagggttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcgggtttgtcaaagatcagatagttgtagatatgcggcattatttctgagggctctgttctgttccattgatctatatctctgttttggtaccagtaccatgctgttttggttaccgtagccttgtagtatagttagaagtcaggtagtgtgatgcctccggctttgttcttttggcttaggattgacttggcaatgcgggctcttttttggttccatatgaactttaaagtagttttttccaattctgtgaagaaagtcatttgtagcttgatggggatggcattgaatatataaattaccttgggcagtatggccattttcacgatattgattcttccaacccatgagcatggaatgttcttccatttgtttgtatcctcttttatttcattgagcagtggtttgtagttctctttgaagaggtccttcacgtcccttgtaagttggattcctacccattttattctctttgaagcaattgtgaatgggagttcactcatgatttgactctctgtttgtctgttattggtgtataacaatgcttgtgatttttgtacattgattttgtaccctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcgttatgatattggctgtgggtttgtcatagatagctcttattattttgagatatgtcccatcaatacctaatttattgagagtttttagcatgaagcattgttgaattttgtcaagggccttttctgcatctattgagataatcatgtggtttttgtctttggttctgtttatatgctggattaccgttattgatttgcatatgttgaaccagccttgcattccagggatgaagcccacttgatcatggtggataagctttttgatgtgctgctggatttggtttgccagtattttattgaggatttttgcatcaatgttcatcaaggatattggtctaaaattctcttttttggttgtgtctctgccaggctttggtatcaggatgacgctggcctcataaaatgagttagggaggattccctctttttctgttgattgtaatagtttcagaaggaatggtaccagctcctccttgtacctctggtagaatttggctgtgaatccatctcgtcctggactctttttggttgataagctattgattattgccacaatttcagagcctgttattggtctattcagagattcaacttcttcctggtttagtcttgggagggtgtatgtgttgaggaatttatccatttcttctagattttctagtttatttgcgtagaggtgtttgtagtattctctgatggtagtttgtatttctgtgggattggtagtgatatcccctttatcattttttattgcgtctatttgattcttctctcttttcttatttattagtcttgctagcggtctatcaattttgttgatcttttcaaaaaaccagctcctggattcattaatttttttgaagggttttttgtgtctctgtttccttcaattctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttattctcattggtttcaaagaacatctttatttctgccttcatttcattatgtacccagtagtcattcaggagctggttgttcagtttccatgtagttgagcagttttgagtgagtttcttaatcctgagttctagtttgattgcactgtggtctgagagacagtttgttataatttctgttcttttacatcttctgaggagtgctttacttccaactgtgtggtcagttttggaataggtctggtgtggtgccgaaaaaaatgtatattctgttgatttggggtggagagttctgtagatgtctattaggtctgcttggtgcagagctgagttcaattcctgggtatccttgttaactttctgtctcgttgatttgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgttggtttaaattctgttttatcagagactaggattgcaacccctaccattttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtggataacccgacctttctctctggctgcccttaacattttttccttcatttcaactttggtgaatctgacaattatatgtcttggagttgcttttctcgaggagtatctttgtggtgttctctgtatttcctgaatctgaatgttggcctgccttgctagattggggaagttctcctggataatatcctgcagagtgttttctaacttcgttccattctccccgtcactttcaggtacaccaatcagacgtagatttggtcttttcacatagtcccatatttcttggagactttgttcatttctttttattcttctttctctaaacttcccttctcgcttcatttcattcatttcatcttccgtcactgataccctttcttccagttgatcgcattggctcctgaggcttctgcattcttcacgtagttctcgagccttggctttcagctccatcagctcctttaagcatttctctgtattggttattctagttatacattcatctaattttttttcaaagtttttaacttctttgccattggtttgaatttcctcctgtagctcagagtagtttgatcatctgaagccttcttctctcaactcatcaaagccattctccgtccagctttgttccgttgctggtgaggaactgcattcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacagacaggaccctcagttgcaggtctgttggagtttgctagaggtccactccagaccgtttgcctgggtatcagcagcggtggctgcagtacagcggtggctgtagaacagcggattttcgtgaaccgcaaatgctgctgcctgatcggtcctctggaagttttgtctcagaggagtacctggctgtgtgaggtgtcagtctgcccctacttgggggtgcctcccagttaggctgctcgggggtcagggacccacttgaggaggcagtctgcctgttctcagatctccagctgcgtgctgggagaaccactactctcttcaaagctgtcagacaggaacgtttaagtctgcagaggttactgctgtctttttgtttgtctgtgccctgcccccagaggtggagcctacagaggcaggcaggcctccttgagctgtggtgggccccacccagttcgagcttcccggctgctttgtttacctaagcaagcctgggcaatggcaggcgcccctcccccagccttgctgccaccttgcagtttgatctcagactgctgtgctagcaatcagcgagactccgtgggcataggacccgccgagccatgtgcagaatataatctcctgttgtgctgttttttaagcctgttggaaaagcgcagtattagggtgggagtgacccaattttccaggtgctgtctgtcacccctttctttgactaggaaagggaactccctgaccccttgcgcttcccgagtgaggcactgcctcgccctgcttcggcttgcacacggtgcactgcacccactgtctggcactccctagtgaggtgaacccggtacctcagatggaaatgcagaaatcacccgtcttctgcgttgctcacgctgggagctgtagaccggagctgttcctattcggccatcttggctccactatcctatctttctcatcccctgcaaggcaggcttctcaaaaaagatacctgcagttaatttctccgttttctcttccctgggtcattctcagcctgttgcagtctggtttcttttcccatattatataccgaaatgagtcttgtcagggtcaatgatgatctctgtaaattttataaaaatttattttgtaataatgtagacacatgttcatagtgtaaaactcaggctacagaatggaaaacagccaaaagtaagtctccctattacgttatcttgaccagccctgccccacttggggctgacttctggtaaccactttcttgtgcctctgacctccttatctgaaggcccctgtggctcaccctgtggcttgctctaattcttaggatcttttaagttctaaagaaacaatagaagctttgcattaatattaagcttatacaccctggtccaggagcagttccatcagtcatcagtgatctcttctgtcctttttgatggcttttcctcttaaccttgtaagaacatgctagacttgggtcctcctctgctgttccttacatatatatattttatattttttttctttttctttttttttgagatagagcctcattctgtcacccagctggagtacagtggcgtgatcttggctcactgcaacctctgcctcccgggttcatgcgattctcccacctcagcctaccaagtagctgggattacaggagcaccaccacacctgggtaatttttgtgtttttagtagagatggggtttcactatgttggccaggctgggcttgaacccctgacctcgagtgatcctcccacctcggcctcccaaagtgctgggtttacaggcatgagccaccatgcctgtcactcatctcagtcacagctgccacagggaccccaagcccgttataacccaggctgtactttctgctttcacctgccccaaatctgctcctcctcgaagggccatctgtgggccaggcgctccagtcccctcactctgttcccacaagccagcagccagtgaccaaggctgtaaatcctgtcattgccttgatgtagtcaccaatatttatgtgacaccatactgtaccagactctagacctggcttgatggctctaatggtaaaaatgtaagtgtggtactcatgctcatggaacttatcgctaagtgggaccaccatatctttccagtctgtcccttccttatcctacttcctgcctcctcatcacttcctcacttacctaattcttttcttcttctcctttgctttcctcaccctcctctaggccattccctctcccttttggaaggcagggggaagagacctcaggcacagggacggtccacacacccagttcctgacacattgcctctgttgtgctgtgcaaggccccgctctcagacttatttatattttattcattttctctccatccccattctcaccctgccaaagccaactattctaatgaattaagtggttttccttttttatttgtgtatgttcatgaaacattttgtttttgtgcaaataccttctaaatttatatacagtaggctgggcgccgtggcgcatgcctgtaatcccaaaactttgggaggccgaggtgggcggatcaactgaggtcaggagtttgataccagcctggccaacatggcgaaaccccatctctactaaaaatacaaaaattaggcgtagtggcacatgcctgtaatcccagctactcaggaggctgaggcaggagaatcacttgaacccaggaggcagaggttgcagtgagccaagattgtgccattgcactccagcctgggctacagagcaagactctgcctcaaaaaaaaaaaaaaaattatatgcagtaaaactgcctctttttttttggtgtagaggtttacccattaaaacacatatgtgtaaccatcaccccaggatgtcaggatgcagaacctcaccccaaaacattcttttctgttgcccctttatagtcacaacctccccttgctactgacccctggcaacatatatcacctcctgtgtgatatactttttttttcctgaaacagtctcacccttgtcacccaggctggagtgcagtggtgtgatctcagctcactgcaacctcggcctcccgtttcaagcaattcttcagctgcagcctcccatgtagcggggattataggagtgggccaccacacccagctaattttagtagagactgagttttgccatgttggccaggctggtcttgaactcctgacctcaagtgacccaaatgcctctcgacctcccaaagtgctgggattacaggcatgagccacagtgcccagcctgatatacttttaatgtacataattgtattttatatcatttatatctcattctccatttttctgtatgttaaagatatatagttaatctgctacacagcagcccagaatgtgcatccatttagtcctaacaaaaggcctaggagcaagatgctattattacccattttgtagatgaggaaaatgagcaataagtcaattgctgtaagtcacagggggttaaggagcatcacagagatctaagccctgatgtttttgacccatgaatgcctttgttcttgcctatatccagctaatcccatccatccagttcaaatgtcctttgtactgcacaaacagttttctcaagagtcctctctcgggaagtcatacctccctcttatgaatttccattgtgctttatgtatcttttctttcgttaccttcccctcctgctttgactgtagctgtcggggtgcctcgctcatcttagcatccccatggcatctgacttgatgcctcatgcatagcttatcttcactaattatcagttgactaaatgataggatgattcagagactgttaagtaatcttctaatgcaatccagagcttgggagggtcagtgaaagtgtagagaaaggaaatcatatgacagaaattttcaagcaaaactagttgtggcccagaggctggctggagggagaaagacagaagaaggaccatcggccacagtcgggctttgatcccaggatgtttgttgaatgcaggaatgactccaagcatttaaagctgggggctgccaggattcctagagctactggcttttgcccagaagttcagagtacaacctgtcaggaagggtggataattggagtttagcacacagcgtgaagatccagggcgcggtgggaaagccaggttgaaatgccttgggaatgcggcttggaagagaggatggcccacagctcaggatgctagggtctttggcatagaggtggtcatggaaaccctgagaatgagggacccccatattctggggacatgggagagagagaaaaatagagggatgaagactgagctttgggaaatatgcacatcttgggtaaaatgaagaaagaaagtgaaatgtgaaaagaaaacctcggtagcatgaggtaagagaagaaaggaaggagtgagtttgaagaaggtccaggtaagggtcactcatgtctgaagtccaggaggatgtggctgagaagaagcccttgaatgtgatgagaaggtcttggatgacccacggtgaagcagggaggtatgggagtgaaaaccaattgcagcagggccaggaggggtgagaggagtctggggcacttggggtcattggacagggcaggggcaggggcagcagaggactctgagcactgtagagggagctccaggaagggaagcgggagtgagccaaggcgctatacactgcagaattctcaccttcctagagcagccctctgatatttatgtctgttttcagtggtggtttatattttagatagtgaatacatttgtgtgattctaaactttaaagaggaaaaaaagaaaaaaaaatattttctatgagaagccttcttccctcctatccctgtttcccagccactctgtttttcttgctcccagcaagagcatgtcgccagtttcagtgttacaggtttctgggctgtcctttcaaagagattctaaacatagacagtatctttttcctttggctaccacccctcctgttactacacagactgtagcacacagtgcacactaggctgtcgtttgcttctttcacccgatcatctatcttggagaccagtccctttcaatatataaagggcttcctcgttcttttatttttatattgccatgtaatactctatatcacgagtctatcataactttcatagccagcctgttattaatgacatatagattatttccatcttttgcttgttataagcaaggctgcagtaagcctaagtcacttgacttgtgtagctctataggacacattatcttacagttggatttaccagaacaaagggcatttgcattttaatttgtaataaatatttccaagttgctctccataaagcaggttcttctctccctcctgcaacatatgaacatacctgtttccccaggccaaccaatgtgttatcaaacttttttttaattcttgcaaatagtggatgaaaacgactagtttgttctgtccaactgcctggactctccttccaccttttcagcacctgccctcatgcctcaccttgaagtttttctacagtgattttacattttcttctaccctctttatctcaaaaaaaattttttttctaagttggcagagcacattcctaactatgaactccatttttgcatctggagtgccaaacaccagcttctctgagtccaagggtgggggcgcaagctcactctgtgactgtgatttggacctaagtgagttttttagtcactttgctgtgcttatgtgtccttttctgctgtctcaaaactgctcctgttctttgttccttaaataccacctctatagggctatttgtagtggcattttcccaaaggttcaggatagcagagcacagcagacaactgaaaatggaactgtggatgtcctggtttctggaagtccattgctccctcctccactgggcgtttctcactggcttccttctctgcagattttagccttttgctaacctgcgtgcactttcccctttcctctgcctcctactggttcctagccccaaagttttagctgctactacagagtggtctagccatctctgatttgcagtttcccttcagaacgcaccttcaagatccctcatgtaaaatgaagaggctcacgttaaaaggcctaacaagtaatttttctcaaaaataaagttcttcccctaagagcagcttgactattaagataccagtgtcttcactcatatctttttttttttttttttttttttgagatggagtgttgctctgtcgcccaggctgaagtgcagtggtgcaatcttggctcaccgcaacccctgcctccccggttcaagcgattctcctgcctcaggctaccaagtagctggggttacaggcacccgccaccaccatacctggctaattttttgtatttttagtagaggcagggtttcactatgttggtcgggcaagtctggaaactcctgacctcaagtgatccgcccacctcagcctcccagagtgctgggtttacagacatgagctactgcactgggcctttcacccatatcttgtccctgtgtgtcagttttgcaaggcagtaatatcgaaaccaaatcctaaagcagtttataatttagcctgacacactgtgcaagccaggttttgtatgcaagtttgtgtgtatcattaactaatgaaatcttaaaaagcagtttggcttatttatagataatggagctgtttcttaaccttgtgccttttttttaagctggtagaagcatatcctggttattatctggaatgtagtaatacggtaaccttaagaatgccataaatatttaacctaataaggggattgctagtcttcttttcttgattgaaagggaaacaaatattaatatttgatcattaatatgtgttttggctgtacagatttctccagaggctgtcttactgctttttggtaattagaaattaccaaaaaaaaaaaaaaagaaaagaaaacaagactagtaacccaaaaaggacttacttggtgaaattgtcaattgtcagttgggcactgtggccactccttcctatactcttccctgacttccagaagagaagccaggaactaggtctcccagagtccccttttatatgtgaagtccactcccaggactcccaggaaacttgcaaggctgaagaaagagaggcagttagtcataggagacagttcagtcagatgtgtgagccaaggccagtgtatggtttagcagcagtggacagtcaggctctgtgaatcactcttcccaagctgcaggctgacagaggctgagatcctttccagacgtcttggcttctgggcaagttctggagaatctctcgcttcaatattgaattgtataacaacagtacaaggtctaggagaaaagaaatggaagtgtactgttgtcaggttctttatagtatatgtggaatagtgcataatattactttaaagtagactgtggtaagtaaaatatataatataaaatccttaacttctgaaaaagagttatagctaatagccaacaaatgggataaaatggaatcataataaatattctaattaatccaaaataaggcaggaaaagaggggaaaaagaacagattgaacaaatagcaggatttctatagaatttgaatggaaacccaaccatatcaataatcacaatgtaaattgtctaaacgtttcaactaaaaggcagagattgttagactgagtaaaaaaaagcaagacctaactatatgctgcctataagaaactaactatagctatgaaaacacatatagattaaatgtgaaaggttggggaaaaaatgtattatgcaacactgatcaacagaaattgggaatggattgttaatatcagacaaaataaattatagggcaaaaaatattaccaggaataaaaatggtcattttagaaagataaaggggtcaattaaaaaaaaggacataaccatcctaaacttgtatgtatctaataacagagttttgaaatatgtgggtcaaaactgatagaactgaaaggagaaatacacagttatatacaattatattcagagatttctctaccctcaataattgctagagcaaggagacagaaaatcaggaaggatacgaagacctgaacaacacaatcaaccaacttgatctaacagacttatagaacactccacccaacaatagcagaatacacattcttttcaagtgtgcccagaacattaaccaaggtagaccacatcccgtatcataaaatatctcaataaatctaaaaggattcaaatcatttaaagaatgttctctgaccacagtgggattaaatgagaaatcaataatagaaaaacatttggcaaatccccaaacatttggaagaaatcctggaaggagaagacaagagcagtgggcacaggaagaggggcagagtcagtgggaagtggtgacaactgggtacagaggtgaagaaaaggggcaaatctgagatgacattcatgtttctatgctcagaggcatccaagaagtgagtttaagggatgcatggagataatttttttttttttgagatagagtctcactctgtcacccaggctggagtgcagtggcgctatcttgggtcactgcaatctccgcctcccaggttcaagcaattctcctgcctcggcctcctaagtagctgggattacaggcgcctgccaacaggcccagctaatttttgtatttttagtagagacgaggtttctccatgttggccaggctggtctggaactcctgacctcaagtgatccacctgcctcggcctcccaaagtgctgggattacaggcgtgagccaccgtgcccagtgcatggagataaattttatcagtttttattatactgagttgctgtataacttaaaagtcagtttgatttttcactgtaatactgttcacatacagcctccagcagtgcacttaaataatatttaagatactgcagtatcttaaatgtggaactcagaaggctgtagtgaagagtcaaagcctctggatcccacgctgagtaaggtgaccaatcatggtttgcccatttgcctcctctgccagcatctgatgaagaagctgtgccctctgaatgactcccagtagtatcagattcatgtgtccactggaggagggacccagggagggcagaagtaccaggccatgggctgggtctgggttaatggggaaagctccctcattattggagatggggcagtagaagtggagagccaaattgggggaacactttctgtgggtactcggaaggttttcaacctaaagacatggtggagcaccttcaagaacaggttttggcgggactgacttctctccaagcccccatttcggggactgtctcatcccatcctgatgctgtggcttcctgtgtgttttgggctggcttccatcttgctcgtcgggaccctgccagctcctttgttttgtagttttctgctcgatgcctacagtgttttcagactccaccttggtcccttgtgtttcagcccgagaggaagtttggcgtggtggtggttggtgttggccgagccggctccgtgcggatgagggacttgcggaatccacacccttcctcagcgttcctgaacctgattggcttcgtgtcgaggtggctcacaatgtctttgtgcttcataattcatggaaagcccagtgaggcggattagctgcaggacatggagattttccagacccagggcagggagagccatctcccaactgagaactgtgcttagggtcagccccataagatctcaggttgggatgggtctgggaactgaagcttgctgggcctgcagctgggatgcacagtaggttggcctgggagactggaagacagaggcaggagggtgagctcaaggctgacagttagagaaggggcacagaaaacacatgcatggggctttggcctgaaaggctttcggtgtgcaccggggaatcctgacatagtcatcatgacagccatcctaggtggtcctgggctctacatgtgatatttccttctgcgtagtgttattaaccccccagtttacagataaggaggctgaaccacagaaaggttaagtaatctgcctgaggtcacacagctggaaagtctaagaactgaagttgagcagaagtctgtttccaaagcccatcttttaaacaccatgtgttcttttgccattggtaattttgagcctcacttttattattattattattttttttgagacagagtctcactctgtcacccaagctgcagcgcaatggtgcaatcacagcgcactgcagccttgaccgtctgggctcaagtgatcctcccgcctcacagctcaagtggtcctcctgcctcagccttctgagtagctgggactacagacacacacaccaccacgcctggataattttttttttttttttgtagagacagggtctccctatgttgcctagactggtctcaaactcctggggtcaagtgatcctcctgcctcggcctcccaaagtgctgagattataggcgtgagccagtgcacccagcctcccccttttctttaaggattcatttatctccagtcaaaatcaaacttatcaccttgtttcttcttcccccatgctcaaattttccactcacccctgtacacacacacacacacacgcaccactcaccagactaatcctgtataacatcatttgtcaatattaattgtgaactagatacaggcaccagactaatcctgtgtaacatcatttatccatattaattttggactaggtgcaggcactgggctgggcctgaagacatggtagtgagcaagttaggcaactctttttctagtgctttagagacatcagataaatatttacacaaagcataagtaacaattgtgatagtctatgtagaaattttttcatgttttcattcatggggccatcctcttccggcctgtctcaaaacatggccccacttttaaggatttaaaatgggcttggaagcaccagggagacccagaagtgctagaatctgcccttgggccagccttctcctccccataagattccaagggagctgcacacaaatgggagagcaaagttaagatcaggcagcaccgtaacccccatcgcacccctatctggagctgggaccacacacagcacttgggcgcaaggctgaaatgggacctttccttttcccttaagccccagtcctctgccagttggcttccagggtcagctcagtgggaacacctacactacccaggttgtatgggaggatggccaggtcacacccctgcatgacagccctgccagtactcacactgtttccctcttcacatacccttcccttcctgacctacctgctaagttctacctcctccccaggaagcttttctggtgtattcctttcccaccctgagtctccatctcctacttccaagcaccacatttctcctggtagtcttgtggtagtggtatgtacgtgtgtgtgtgtgtgtgtgtgtgtgtgtcttcctctagctgactgagctcattgaaaggcgatgattttaatttgttctccatgatttctcctacagcgcctagtacataataggcaaacaataagtattgctgaaattgagcaatttagtttgggtggccccattaaagaaacctagcataatactctttgggagctaaattttcctgaatgctttctgcctgctgcagctcagctggagctctgagcgggctgagggccttctgcttgctagctgtcccacattcccccatgactgccacccttagagggctactctcctgccccagccgctgcactgggaggtgtacggactgctggggctttggctcttcgaagactgcagctcccccatgctctagaagagtcagaaggccttgggttcccctcctgcttctgctcctggttagtcaaggctatcactgcctattatgtgctaggcattataggagaaatcatggagaacgaattcctcaccttccaatgagctcagtcggccagagggaggaagacacacacacacacacaaacacacacacagacacacacacacacaaacatgtgtgcgtacatactactgggcttcgttagcttagctataaagtagctcgaagtcgcatgccagtttgcaccctaaatgtgttaacgtattggatttggattaggtttggtagtcacaatgtttggccaagtgcttggaactggaagtgaccatagagatcacttctcatgagataaaagtagattgttccttttatttttatgttattttatttttgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggttttcaccatgttggccaggctggtcttgaactcctgacctcaagtgatccacccacctcggcctcccaaagtgctgggattataggcttgagccaccgcgcccagctgtttcttttgttttggagatgaagtaattcaagactctcccaggtcatacacgctgtgaatggtactgttggcactcaatgccagatcccctgacttgaactctgaggctatttttctcactccacaatggaaaatagcctggaagtgggagagaagaaactcatttcttcatttctggcagcagatcaccaggacctgtcgggaggaggggagaaggatggtgctcctttcttctgtctaccattgagttccatttctctgttactctgaaatagaagggagctcgggagcattgatggagtccagcagatttctttggaggatgctctttccagccaagaggtggaggtcgcctatatctgcagtgagagctccagccatgaggactacatcaggtgggttttccacacaggcagtccttgccttacacagcagtgcagtactgcaaaaatgagcaagcaagctaaaacaccctgcaaaggagtcagaagagccagtgagaaaattacaattgctctgtgaccaatcacagaagtgtcaaaacattaagaaattcttattgctggttataaatatataaggaagtgaaaaatagtaaaattaatatttagtatgtgtaatttgaaacattagaaacattcagaattaaagtgttttatttctctgtaaaaacccatcgagagtagttttcaacagtagtggcctccttcttctcaccagacagtttaggatgtggagccggcatccttggcaaattatcatactcccttctcagtttggatcagcttccaacgttttctcctttgtgctttcaatgtcataaaataacggttgagttcctttaaccctcaggacctggcagctaacagggaagtgccagctgccttcctcagtctagcttccttctaggttcttacagctgctcccaccatgctgtttcccacgggtaagatgcttcctctttatcagtctagctctagagtagacaaaaacacctctccttggctttccttaaccttttctggcaccagagtgtatttccttaagaaaagtgattctgacataagtcccatgcttataaatatttgtactctggtatccacagaatgaaatctgaactgctgagcacagaattgtaggtccttcacagtcaggcccccagctacttttccaacgttattatcctccacggcctgtagtccactcccctgccacactgaagtttgccgattgaacaaagccccacaaatgcccaagcccctgcatacgctgctcacagtgaaatatactcacatgttgcacctggaaaatgtctgctcatactttgagacccagttcataggtccttagtgaaatcttttcagactgcctcaggcaaagctagccgctgtgggttttgtagcctttatagctaccatgtggtgataggaaatttatttgttaatgtgtctttatttctcctccacagtaattggtaaatagtacttagttgaataaatgaatggttgaatgttcaaattaacacataaccagaaagttgatctgtcacaggatagtagaaaacaatgtgggatacagttcttcctccatatcccgtggcactgactcctacccccagtcatgacacattcacacacagaaactctcatgcctttataacattctgttctctattatgcagagcatttcagtgaagcttattcgaagtgttctttctctgtatttgtctcgtttaccaaaggcagttccttaatgctggcaagcacgtccttgtggaataccccatgacactgtcattggcggccgctcaggaactgtgggagctggctgagcagaaaggtaatgtatcttaccaagagtttctgcctccaggatttctgtgatatcatctttatgcctttaaaacttaaccccatttcagatatctcctcctcctggctacactggcactgtgggctcccaactgcctcctcacccccacactgtaaacacagatagtggagggcagaaggatgggtgggaatttgcaaacttttggtcaaagcttatcagcttattttactcactctaaggaaaaaatatgaattagttttcacctatgcttatgtcatgatattattttggctttattcatgtgatacttatattgctaaatgctgggatatcctaaaaatgctcaaatcagagaaactgattgtcttatttgcatagtttgtagtttttgttgtttctaaacaggaataaccatttattaaatatttagtatatgctaggaacttggaaactctgctaagcacttcatatgttattttgcttaattcttctagaatcccttggaggtatatattttctctagatgctgtatagaaaaatatggctcaaagaagttaatttgtgccaggtcacaaagctaataacatgactactaagtgggaggtagagattttaatcaaatcctacagggctcttaagttcacatttgttcccctaagccataccaccctccagaagggagaaattaagactttcccaggccagacgcagtggctcatgccctgtcagcccagcactttgggaggccaaggagcttgggacaaccctgggcaacataatgagaccctgtttctacaaaaatcttttacaacttttttttttttttttttggtggggtacagagtcttgctgtgtcacccaggctggagttcaatggcaccatctcagctcactgcaacctccgcctcctgggttcaagggattctccttcctcagcctcctgagtagctaggattacaggcgcccaccaccatgcccagctaatttttgtatttttagtagagatggggtttcacgatgttggacacaatggtctcaaactcctgacctcgcgatccacccacctcggcctcccaaagtgctgggattacaggcatgagtgaccgtgcccggcatacaaaatttttaattacaagaaaaaaaaaaaaagactcagctgggcacagtggctcacacctgtaatcccagcactttaggaggctctgatggatagattatttgagcccaggagtttgagaccagcctgggcaacatggtgaaaccccatctctactgaaaatacaaaaattaactgggtgtggtggtgcataccggtagtcccagctacttggaagttcacctgaaccttaggaggttgaggctgcactgaaccatgatcgggccactgcactctagtctgggcaacagagtgagaccctgtctcaaaaataaaaataaaaattctttaaaagacctacccagacaaacaaaaaccaagtgagttgatcactactagacctgccctacaggaaatgctaaaggaagtctttcaagttaaagtgaaaacactagacagcaacacaaaaatattgctctctggtaaaggtaaatatatagacaaatacagacttccgtagtattgtaatgttgacatataaatcactttaggccaggcacggtggctcaagcctgtaatcccaggacttggggaggccgaggcaagcagatcatttgaggtcaggagttcaagaccatcctggccaacatggtgaaaccccatctctactaaaaataaaaaaattagctgggcgtggtggcgcttgcctgtagtcccagctactcaggaggctgaggcagcagaattgcttgaacctgggaggcggaggttgcagtgagctgagatggtgccactgcactccagcctgggtaacaccatgaaactctatctctaaataaataaatatcactttaaatcctggcatagaatttaaaagacaaaaaaatacaaactatgttaatggatgtatagtataaaaagatgtaattggtaacattaatagcaaaatggggggtcagagatataaaggagtagaattttgtatgtgattgagttaagttgttagcagtttaaaatagattatgcagtcgggtgtggtggctcatgcctgtcatcccagcactttgggaagccgaggctggtggatcacctgaagtcaggatttcaagaggagcctgggcaacatggtgaaactccgtctctactaataatacaaaaattagctgggcctggtggcacgtgcctgtaatcccagctactccagaggctaaggcacgagaatcgcttgaacccaggaggtggaggttgcagtgagccaagattgtggcattgcactttagcctgggcgacacagtgagactccatctcagaaattaaatacatacataaataaataataaaaatagattgtgcctgtaatcccagcactttgggaggctgaggcgggcgaatcacctgaggtcaggatttcaagaccagcctagccaacatggtgaaaccccatctctactaaaaatacaaaaattagccaggtgtggtggcgcgcacatatagtcccagctactggggaggctgaggcaggagaattgcttaaacccaggaggcagaggttgcagtgagggagatcgcaccactgcactccagcctgggcgatggagtgagactctgctcaaacaaaacaaaacaatacaaaactgacaagatgtaatgaaagcagtactaagagagaagtggatagttgtaaatgcttacattaaacaagaagaaagatctcaattcaacatcctaactttacatttcaagggactaggaaaagaagagcaaactcaatcgaaaattagcagaaaaaagcaagtaaagattagaacataaataaaatagagagtagaaaagcaatagaaaaaaatcaacaaaaccaagtttttttgaaaaaaatccataaaattgacagaattttagcagattaagaaaaaaaagagtcggccgggtgcagtggctcacgcctgtaatcccagcattttgggaggccaaggaggacagatcacaaggtcaagagtccaagacctgcctggccaaaatagtgcaaccccatctctactaaaaatacaaaaattagccaggcatggtggcacatgcctatagtcccagctactcgggaggctgagacaggagaatcacttgaacccaggaggtggaggttgtgctgaggggaggttgtggtgagccgagattgcaccactgtactccatcctgggcaacagagcgagactctgtctcacaaaaaaaaaaaaaaaagaaaagaaaagaaaagaaaaaaagagtaaagactcaaactaaagtcagaagtgaaagaggagacattacaacaaatgctgctgaaataaaaaggattatatgagactacaatgaacacttatacaattgttatactccaacaatcggataatctagaaagggataaatacctagtagcatataacctactaagactgaatcatgaagaaacaaaaatctgaacagatttataactagtaaggagattgaaccagtaattaaacacctcccaataaagaaaagcctaaaaccagatggcttcactggagaattctaccaagtgtttcagtctcttcaaaaagtggtcccaggaaaacaggatatccacatgcaaaagaatgaagttggacacttaccttacaccatataaaaaattcactcaaatggattaaagaactaaatttaagacctaaaactgtaatattgttagaagaaaacatgggaaagcatcaagatattggatttggcaataatgtcttacatacgacatcaaaaacacaggcaaaaaaagcaaaaaacagacaaatggactaatcaaacttaaaaccttctgtgcctcaaaggaagcaatcaactgagtgaaaaagcagtctatgtaatgggtgaagatatctgcaaatcttatctttgataagagatcaatatccagaatgtctaaagaactctacaactcaacaacaaacaaaccaaataaactgattttaaaatgggcaaaggacttggatagacatttttctgaagaagttattcagacggcaaacaatcatatgaaaagatgctcaataccactaatccttatagaaaatgcaaatcaaatccacagccaccgtcagtaaccaccagcatcagtcagcagccatcaacatggaagcaagaccttccttcagcaaaaagatggaggatcagatggtagcattttttgtttgtttttgttttttggttttttaagacagtctcgccctgttacctaggcttgaacgcagtggcgcaaacctccgcctcctgggttcaagtgattcttgtgcctcagccacctgagtaactgggattataggtgcacaccaccacacacagctaatttttgtatttttagcagagatggggtttcgccatgttggccaggctggtcttgaactcctggcctcaagtgatccgcctgcctgagcctcccaaagtgctggaattacaggcatgggccaacatgcccagctcaataacgtatttttaaattaaggtacgtacgttgttttcctaaacatagtgttatcacatacttaacaaactacaatatagtataaacataacttgtgtatgaaccgggaaactaaaatattcatgtgactccctttattgcaatattcactttattgtggtggtctggaatgaaacctgcaggatctctgaggtatgcatgtaaccgcatacaaccatcaaaatctggaaattggcattggtacattacaacaatctaatcctcaaacctcattcaaatttcaccagttgtcccaataacattctttatggcaaaatgactgagttcaaaatcatgtattatcttttattgacatgtcacttttagtgtccttcattctggacagttcctccatcttttcttgacaattatgaatattacagttagttattgtgtaaaatgtccctaaatttgaatatatctgatgtttcttcatgattagatttggggtatgcatctttcacagaaatagtatgcaagtggccaggcatggtggctcacacctgtaatcctagcactttgggaggccaaggcaggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaaggaaacgatgctgtttttcacattgtgttctgtcaggtaacatccaatatcagttcatctaattactaatgatatcacttcattaggtggtgtctgacgggcttttccactgaaagttactttttttccctttgtaatcagtgattattttgtgagaaggtagtttataactagttaaatatccattctcatcacactgtctgatattcatttattattttatatcagtagaaactcatagctttgttttgtttttctattcagtgctgttgttactttttattattcatattgatgtccacattgttccaaatttgctcagtggggaacctcttcctgccagctcccttgtcattttgttatgtttccattattctttgaattcttgctttctggcacaaagtggttaaggctcatcttgtactttctctgcctcagccttggaattagtcagttctccaatggctaataacgttttgatggcaagatttggacactgcttgtgcttatggctttgggctatctctgcaagccctttcagtgaacagacctgggaatatatggatacggatgtgtgtgtgtactgtggttaccatgtgtgtttatcacaatcaggcattgagtgaacgacaggaaaacaacaaaagacacagctggaaaatacatagtttctttaataaccatggatgtggaaacacagagactgttacatagtgctggggaaaatataacatgttccccagagtttcacggtggggtggggggcagtgggcgaaactacctgtgaggagaaaagcttgtacttattgcaaagcattttgtgccatttagttgttgcaaagccattttgtgccagaaagcttctacttatcacaagaagttccttttgccacattcacgtctgaaggagtgggtgggaaggaccccatcctcccacacacctgacatttctggagactcctgcgacagacatcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttatttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttatgctgcactgcctcctcctgtctagaacagtagctaactgtctcctggcccacagacacatccctgatctcatcttgcctttggacacaggtagataccatcttgttctcttaaattttcatttcatttctcaggttttcgtttcattcatttctctttttttctttttctttttgaaacggagtctcactctgtcgcccaggctggagtgcagtgatgcaatcttggcccactgcaatttctgcctcccaggttctagtgattctcctgcctcagcctcccaagaaggtgggcttacaggtgcccaccaccacacctgggtaatttttgtatttttagtagaggtggggtttcaccatgttggccaggctggtctggaactcctgacctcaggtgatctgccagcctcggccttccaaagtgctgggattacaggcatgagccaccatgcctggccttcatttcattcatttctgttgtaagcttagaagtagcagcctcttcagctggggtgggtgacagtggtagggaggccatcctggccatgtgcccagggcagttatgagtgcttcatgtcttgtgttaggggatgacagagtaccctctgggatgcacacctagacacaactgacgactgccctttttattccatttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatgttagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttgtgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcattacagaaaggagaccctgacatggcctggcatttttgcacggtaaagccactgatacatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaatacaggcttgcagggctaaaatactttgattcttctacttttaccagactactttaaatcactaaagaggatatatatatatgtatatgtaggtatgtgttgtgtgtgtgtgtgtgtgtatgtatatctacatatgtgtacatagatgtatatattagaagcctgaaacttttttattatcctgtttggctggattgactgctgtttccagtagaatgttttactaaaactcaatttaataaacaggaaaagacagagatgcttttatgatagagttgaagttcagccacctgagttttcatcagtatcattaatcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcattcatagcagattagtagtggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataccaggtcttttttaacaaaagcacattcataattttcctcccaaagcacctgggctctgtaaattatttagaacagtaagggttttagagtgtttctggatgcctttgcagagaggtgggtctcctggtagtaaaagaagcagacactgggtattttaaaaagaaaaaagaatttgagttcctgaatgaagcctgatctagtccattttgaggagtttcttcttcgctaggaaaaggcagagaggcctggcagatgaaagcaaagcacatggaacttggcagtgctccctatggagtgaccaacagtggtggcccgggctctggtgtggccatgtgagtgttaggattgcagccgtggtcagacctatacacagacagttgtagcaccctgtaattagaggtaaagatactgtagggtgctgtaggagcacagggaaggggaacctggactaggtcagctcatggttctgatgggaggcggtgccttgtttggtcttgaagttgagtagaagtcaatgaggaagcaagatgttggggaggcagaggctgactctctctctcttttttttttttttttatgagacaaagtcttgctctgtcacccaggctggagtgcggtggtgtgatctcagctcactgcaacctccatctcccgggttcaagtgattgtcctgcctcagcctcccgagtagctgggattataggcgcctgccaccacgcccggctcatttttgtattgttagtagagacaaggtttcaccatgttggtcaggatggtcttgaactcctgacctcaagtgatctgctcaccttggcctctcaaaatgctgagattacacgcatgagccactgcacccagccctggctctcatttttgcacaggagaggcaagcatcagatgagggattgggacagagagcagttaatataatataatagtaacttcttaaaatcatagtactttccgtgtcccaaattgcatttttaaatttttttatctatttatttatttattttgagaccgggttatgagactggctgattttcgtatttttgggtaagatgggtttttgctatactgtctaggccggtctcaaattcctgggctcaagcgatccacccacatcagcctccacgcctggccacaaactgcatttttatctcacaatgtcacagcaagataggtaaagctgtatacttattaccattacttatttttactagtgaggaaattgaggtacaagaaagatcttgacattctgcattccctcaaatcccaagattccatattatttaaaaggacatgagaggccgggcacaatggctcacgcctgtaatcccagcactttgggaggctaaggcagttggatcacctgaagttgagagttcaagaccagcttggccaacatggtgaaaccttgtctctactaaaaatacaaaaattagccaggcgtggtggcaggtgcctgtaatcccaggtactggggagcctgaggcaggagaatcgtttgaacctggaggcagaggttgcagtgagccgagattgcaccactgcactccagcctgggcaacaagagcaaacatctcaaaaaaaagacatgagaaattttcttaggcagactacgtagaatacctcaagtttatttttattcagtgccaaaataaaagttaatctttgttgccatctcccagaacatttgctagactgtactatgagcttttaaaactagtcatgggaggccaggtgcagtggctcacgcctgtaatcccagcagtttgggaggccaaggcaggtgggtctcttgaggtcaggaattcaagactagcctggctgacatggcaaaaccccatttctactaaaaatatttttttaaaaagtagccaggcatggtggcaggcgcctgtaatcccagctacttgggaggctgaggcaggaaaattgcttgaacccagaaggcagaggttgcagtgggtcgagattgcaccactgcactccagcctgggtgacagagcaaggctccatcccagaaaaaaaaaagtcactgaatgaattcccctgcctgatggcaaaattaaattaaagactgtttggctgtgaggttgacacagtcacccacagcctctgggaggctggtggctgcaaggaggatgggtgcctgacaaggacatgttaccaggcggtctggtgccagcaagcacccacttgtgctcttgtgtaatctctaacatgattcttttgtcttttgtctttgcagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaa

SEQ ID NO: 2245 - DNA, 48671 bp, Homo sapiens; identical to SEQ ID NO: 2244

SEQ ID NO: 2246 - DNA, 43567 bp, Homo sapiens
tttgttacagaggatctttatttataatgcaaaaaagaaattataaatcccattttggactgtttccgtatctgtaaaacaacttataaaaaacagccactccacctgcaagaagttcttgttggtgcttatggcaggggcatgtgtttgcacagccctgggggctgggagggtgtgtttgtccagaagagagcctctccctgggaccccaacagccaggaccatggcgctccctttcaccaggccggagtcagcaagaacctggaggtgtcagaggtccggtccactcagcggggcctgggaaacactgttctggaagtggacaggctggattcctcgctggtcctgccacgtctctctgagcggaggcccgggttcgctcagttcccatccagggtattcagcacacctgctccaggcagccacgcccccggacacctgaagccgggccgctggagcaggagccagccagccaaacccaggacacctcctcaggcttctgggtcgatttctccatcatctgggcacgaccctgtctcatccagccagactaggagaaagaggggatggacacctggatgcaccctgcccccaccacaccaagccccgtttccctgggaactgcagggctggggcctctgggattccttgctttctggtgctgccagaggctgagatgggacccagcccagtgatgctggatccttctgggtgaatcggaccccggaactgcttcagtttaagaggaacccctcccagcgttcaggaacctccctggggctcggactttgtagagtaaccctgtgtctcccctatgcccccactggtcctgggagcagggaaggtggtatgatcccattttataggtgaggacacaggctcagagagggaagagactttgacagccgagctaaggacctgcgcctctgtccgcccacactgggctctctgattagacagtactggggtgcaggaggcgcactgcagcaggagcccagctcttctcccaccttgctgtgtgtccctgggcgaggcactgtccctctctggacctgtttgtttccccatttctaaactagagataagggttggaatgagaattaaatgagatttgtgaaaagcatttagcctggtgccaggcacttggaaaggtcacagaggaatgcgccccattgcacccaccatggctccacccagcacctgcactggcccaacccagaggggcctgacagctttctcccagtcactcgctctgctgggcaagtggagacccaagctcaggacatctggaagggtctatggattccccctcccagacagccttccatgcacactacaccagcctcatgggtgccttgtcccctgcatgggcccagcgagacccatgtcatgatggctgtcagctaactgatgccacttgcggggaggacatccggcctgggggccacggggtgaagtgcagatcacacagcctggggctgcatgcctgcggcacccgtgactagcacatggcaagtgtctcagcctctctcaaccttagtttacccctgtctaaaatgggggtgtggtggctcatgcctgtaatcccagcactttgggaggcccaggtgggcagatcacctgaggtcaggagtttgagaccagcctggccaacacaacgaaaccccatttctactaaaatacaaaaattagctgggcgtggtggcaggtgcctgtaatcccagctactcaggaggctgaggcagaacaatcacttgaatgaaggaggtggaggttgcagtgagctgagagtgcaccacagcactccagcctgggtgacaaagcaacactccatctcaaaaaaataaataaatacaaataataaaatggggatgaaatctgtacttaactctgaactctgagaattcctgtaagaactaaataagaaaatccatttgttacgctcagtacagtgctacctatcatgaccatccccaatgttattattattattattattattattattattattcatagcagcagcctcagcacccggcataggcccagctcagtaaatctctgctcaatgaatacatgaacaatttgtcccaccagctccagaggtatcacagagaggcaggtagggctgccgatttgggcctctgtctcccacctcctcaccctctccctgggaagaactctatttcctcgccgctcccagcagtgagctgcatctggaaggcccagggtccggccccagcctgggcacgagctgtgtttccaagtctgtcctgtccggccaaactgcagcggccaacaagatggagcagcggtcctcccgctggcaggggaaggagcatccatcaattaccttggctggccggagccgcggcgtggcgggccagcccggccccatccatcaagcgtcctggctgctggcaggggctgtctactaattacttaacacgccgcgtcgtgctgaggctggcgccgtggcagggggctcacggtgcagtgtacacaggtctgaccataaatgtttaacgaacccagtgggaggtggggacgcaagctaggccccgtggccaggaaggacgcccctgagagctgtctccaccgggcccccacagccgacccggcttggcggtggaggggacggcctcacctgtgctccccaagtccctcggcagcatcatgcccgtgggggtggggggcgtgatgatgatgtcgggcacgtccaggtgcttgtcgttcaggacgggggcctcgtcgtggctgctgctgctgctgctgacacacatttgaaagcctgagaagccaggcgtggagcacacacgcacgtacacacgacagagagacaggcatcagtggccgccgggaaccgcgggcgccaccctcccttcactatcacctgggtcctgacgcctcgcagcaaggagcgcagctgtccccgcatcacagatgaaaaccggcgtctcaggaatgaaaaaggagcccttgtcacatctcacagaaccatgagtcgggaaacagattttgggaaatgctgatcataggctagttggcctctgggtccagttgtcagcctttaccatgtggcccagccagctgcagcctcattcccggccaccagcccccactctccacagcgctccagcctccactctccaaagtgctcacacttccccagactccctaggctcctggggccccttcgtgcctttgcatatgctgctccccccgcctgggatgctctttcttcctctgcctgagtaacaagctcctgcttatccttcaaagcccagtgcaacgggctcttccttgggaaaggtgtcccagcagatctggctgctccctcttttgcccatctgcactcactcattcatcaatgaatgacatgatttatttttacttctgcctctctttgctgtgaacacctggaggacagtctctatttcattcatctgtgtttcccttgagcctagcgcatgctcgagacagagtaagtaggagtgctttaaatttcaaatgccagccgggcgcggtggctcatgcctgtaatgccagcactttcggaggccaaggcgggcagatcacttgaggtcaggagttcaagaccagcctggccaacatggtgaaacccccatctctactaaaatacgaaaattagcccggtgtggtggcacacacctgtaatcccagctactcaggagctgaagcaggaggagaatcacttaaacccgggaggcagaggttgaagtaggctgagatcacaccattgcacttcagcctaaatgacagagtaagactccatcttaaaaaaaaaaaaaaaaaggctgggcgtggtggctcatacctgtaatcccagcactttggaaggctgaagtgggcagatcacctaaggtcaggagttggagaccagcctgaccaacacggagaaaccccgtctccactgaaaatacaaaaaaaaaaaaattagctgggcatggtggtatgcgcctgtaatcccagctactcgggaggctgaggcaggagaattgcttgaatccgggaggcggaggttgcagtgagccaagattgtgccattgcactccagcctgggcaacaagagtgaaactctgtctcaaaaaaaaaaaaaaaaaaaaaaattaaacgcaaccaaaaacccttcaggcagcattaagctaggtgttacaatccttgtctctatgtcccatcactttggttttgccccaaacggtgccaggctgggattaaattagctcaagtatcagagcccctgaccaacaggagaagctgagtaataaggggttgggggaatatttttcctactgttctcaggcctcccttgaccaccattaggacaatgttcctaagtgaccactgtagggtcagtgtgggggttctgaaatatggctctgagaggcagagtctaagcccttgagtgtggatggacttagtgacttgcttccaacaaataggactgccatgatggtgtgtgacttccacggtgaggtcataaaagacattgcaacttcctccttgctctctcttggaacacttgctcttggggaagccagccaccatgttacgaggatgctcaagcagcctgtggagcagctcacgtgggtgaggaatcaaggcctctagccaacagccacaagggagcctcctcagcagtggagcctccagccccagtccagccatcagatgagactgcagccccggctgacatcttggatgtaacatcatgatcgaccctgagccagaaccacccagataagccactcctcaattcctgacccacagaaactctgagataataaaggtttgatgtttaagccacaaagttttggcatagtttgttatgcagtgatagattactgacagtcagcaaatctttccctgacccagtaggaagggatggcaggtgcacagtgggaatctcatacccggctgtggggaaatcacaggaggcttctcagggtaacctttgttcacccaaggggtgttcctctgagaggcaggttacacctgggctgtcagggatgatctgtttgaatccacaaaagcatgtacacctagaggacctggagccatgccattcaggccaaattcttggttcacctgcagcttgaccaaggctgcaggctcagaaaaactgaaagcagtaggcacactggctttggaatcaggccaccagctgtgtgaccctgcgtgcactgcacctcctctctgggccctttgtgcagtaaataatttaatcttgcctaaaaagaggtctggtctctgtccgcggtttctgagaggtgctctctaagcccttggaatatcttgcctgataggagagtctttgtttgccgggggctgtggttacactgggtgtccaaaggcgtgattgatggaggggggctccgggtcatgcccggagagacagcagcctgcagcctgagctccaaagtgagcaatcaatcagcctccagaggagccccagtgccttcgtctcctggggttgccacaacaaagcaccgtcaaccaggcggctggaacaatggacattcattgtcttatagatctggaggccagaagttccagatccaggtgttggcaaggctggttcctctggaggctgcaagggagactgttccaagcccctcccctggcttctggtggttgctgacaatctggcgttcctaggctcgtagaagcctcaccccatctctacctcttgccttcacattgtattctccctgcgtcttgtctctgtccagactcccccctgctttttttttgagacggatctcactctgtcacccaggctgcagtgcagtggcacaatctcagctcactgcaacctctgcctctcgggttcaaacaaaatctcctgtctcagcctcccaagtagttgggattacaggcatgcgccaccatgcccagctaatttttgtatttttagtagagacagggtctcaccatgttggccaggctggtctcaaactcctgacctcaggtgatctgcccaccttggcctcccaaagtgctgggatcagaggcatgagccacagcgcccagcccagatttccccttttgataaggacacccgtcatattggactaggagctcacactactaaaatgacctcatcttaactcattacacctgcaaagacactactcccaagaaggtcacattctgaggccctgggggcgaggaggttgacttatgaatttttggaagacacggttcaatccttaaagcccctggacactgaagccaaggggcttccctcctgatgatgctctgtgctgtcacgcaccatcgtcaggaggagttggtgctgtccatggctccacgaggagaggacagtgggagactgtgcctgggaccctcgtgggatctgccctgtgagcgtcttccctttggtcttaacctgggtcccttccctggaatgagccataaccgggaatcagagcctccagtgacttctgtgagtcctttcagcaaatgaacaaacatgagggtggtttggggaagccccaaacctgcagctggtggtggaagggtgggtggtcatgtgtgcccccgccccacttctgttagtctaactctttgcagccttcttgttttcacagacaagcgcaaggtggtagtgggggaatcagccgactccctgggctggggagagacggccacggtccctgggacacacggctggtgtgaggtgaccatgatgagccccctttgtcctgtgcacagccactcacttccctcccctcattctcaaacccagtgacgagcatccgcccctcaccccaggcactgccccagtcacctccccaccttctgaaccccaacactgtttcctcctttggaagacctattatttatttatttatttatttattatttatttatttatttatttatttatttatttttgagacggagtcttgctctgtcgcccaggctggaatgcagtagcgtgatctcgactcactgcaacctctgcctcctgggttcaagcgattcttctgcctcagcctccctagtagctgggattacaggcgcctgccaccacacccagctaatttttatatttttcgtagagacggcgtttcaccatattggccaggctggtctcgaactcctgaccttgtgatccacccgccttggcctcccaaagtcctgggattacaggcatgagccaccgtgcccggccttggaagactcttggcccccgactgctgggtagttttgagggaagaggccacctcagcccaacagaactccgagcccctcagcggcacccacacagtcccatcgaagcaggtctaatacagtggggtttgaaccttctttaaagaagagaacatttcagccgggtgcggtggctcacgcctgtaatcccagcactttgggaggccgaggcgggcggatcatgaggtcaggagatcgagaccatcctggctaacacaatgaaaccccgtctctactaaaaatacaaaaaaattaggcaggcacggtggcgggcgcctgtagtcccagctactcgggaggctgaggcaggagaatggcgtgaacccgggaggcggagcttgcagtgagccgagatcacgccactgcactccagcccgggtgacagagccagactccgtctcaaaaaaaaaaaaaaaagaagagaacatttctcctgcaatcttgcacagaagcccagagtgtgaaacaaatcaaaggaagtcacttggagagaggcgcccctaccccaaacaaccacagacaaagggatgtgttgccaccgcccagacaatctactggggccgaggcgtgcgctccttcaggctccatggccaccgtgctcggtgtcaccagccccatcttacaaatgtggaaactggggacctaagagagtaatatccacccacaactgaacagctagtgggaggcagggccaggatccatccccagactggaatctggctgaccccaagagccggtgcttcctgtagcataatcccatgtaacagctggcaaactttctgcaaggggccaggcaggaaatatttgatctctgtgggccacacaaactacacacacagctttgccacggcagcctgaaagcagccgtagacaacgtggaaatgaacgagcatgactctgtctcaataaaactttctttctaaaagcaggcatcaggcaggattgggtctcagggctgtggttgccaatccctgctctataacatccaggactggctgcggaggggagctgagatctaggacacactggcaatagcagaacctcgaaagcctgaggcttgttcgtgccaaaaacaaaagccacagccagaaccccagctgcaggtgggcagggcagctccctcttgaagggctgcgtgtgaggacatgaatgaattcacgaaagcacttcgcccagccagctgccccataagtgttctctattatcatccacaaagagctccttgcggaggcccccgacaaaaggaatcgctgatgatcggaggcccccgacaaaaggaatcgctgatgatcgtgtctgtaacaggagggagcttccctgctcagtctccaaaccccttcctcggtgaatactccaagattctaaaataaaacaccccacgtttgcattttaacgtggtctggagcttgaggacaaaacctacacatataacctggaaggatcaggttctcagtgagccctggagaggcagaagtctcggaggagagggggttggagggagaggaggaaaggaggagagaacggagggaaggaggagagggaaggagggagaagagggagggaggagtaagttgggggagaagagggagggaggaggaagaggaggaagggagggaaggaggagagaggagaggagggagaagaggaagggaggagggagaagagggagagaggaggaagaggaggaagggaaggaagagaggagggagaggaagggaggaggagagaggggacgaaggagaggaggaagggagggaggagacaggggagaaggaagaggagggagggaaggaggacagagggagggaaggggagagggaaggagggagaaaaggagggaggaggaaagacagggcaggaagaggaagagaggaggaggagggagcagacaaggcagagggagaaggaggaggaagggaaggaggaggaaggcgagagggaggaggaagggagggagaggggagggcaggcagggaggagagagacaccccagcccctctcacatccccagggcctgccaagcctcagcagcagaggtggccaaacaggagggaaagctctcaggaggatgaagccaatgctggggattaaaaaccaaatgccagccctgccccagacaaggagctcatttgtgctaaggccagaattgttatttgttaattatgtgcctgcctcgggctattaaaagcctatttcctgagcctgggattccagaaggaagggagcagatcccagggacccaggcccgtcccaaggcttcagaaggatggagcctgtgcaggaagacctccccacttccggggaggcttcgtgctccgggtcaccaggccctgacccccgctctgcggccatgcactgtcctcgcagtgggggcagagccacgcagaccagaccacagaacccaggcccctggagctggatttccacatgggttacataggcgggtgctggcatggcgaggttggacaggctttgagacccggctctgggccctcctagctccaggacagcggttcccatcgcggctgcccattgagatcacctgggaagttaacatcacctatccagggcctcagcccaggctgattcaaggctctgtgagaagtgccaggattttgaaaaactcccaggtgactttaacagccagggatgggaacccctgagctagggccactgtgggaacaggtggctttactcttgcagcctcagtttccctggctgtaaaactgttatgacaccagccttgcaggaagtgccaggtgtggggtgtggggctgccaagtgtggggagaaatgaccctcggggagccagctggccggggcctagggggtcctgagctgggggtgccgtgccgcctctccgctgagaccactacttccaaagcatccggagccaggctctgggctgagcctgccatttgcactcctgcattcaaccctcacaccatccctcagggagaacactaggatcacgcccatgctacaaaggagaacactgagctttggagaagggaggtaacgtgctggtaatacacagagcctggggagcagggctggggcttgacgtggctccaggccccactgccctcaccattgctgggatccgcagccctgatccttcaaaagccctgagccaggcaagcccgtgcccgagacgctacatccaggctctgtggaggatgcccaggtccctggggtcagggcaccattccctgtgccagctcttggtgaactcccggccgcccagaggtcaccgcagacacccgctggagacaggagcaagcgtgggcatcacggctcacgtgcgccctctactagttctttttcatttcatttaaattaatgaattgattttttgagacagggtctctctctgtggctcaggttcactgcagcctggacttccctggctcaagcgattctcccatcttggcctcccaaagtgctgggtgaaactacaggcactctccaccacacctggctaagttttaaacttttttgtagagacagggcctcattatattggtcttgaactcctaggctcaaacgatcctcctgccttggcctcccaaagtcctggggttacaggtataagccaccccatacggcctgattcttttaaaaacagcgtttgggcttgcaccccagacgtttcacttggaggccctgaatgggaccacgccctcttccccaaggcaccatcacacacacacagggctccagcctgtcggacccacgatgcgatggacggccagacggcccacctgggctacggtccacctgggcagtggctccccctctttgggcctctgcttcctcacctgcagaactggggtaaataacagtgcccaggtccgggtgggcaggcatgagaggttaaggaccacacttgagtcctcactccagccaatgcggtgcgatgattctatatgcgttttgtggatgagaaaactccagtgctggcctcgctgtgcacacgtaataaacacaagctgtcattcagatcacgagttgatgctaagcttagatccacatcacgtgatttgaactgcaggtgtaagtgtcctcagggcacttattcattgattccttcaacattcagcacctactgggtgccaacggctactgttccagccccgagtgtgggtcgggggacttgtcgcccccttgcggtcacgcagctggagtgggtgctacacaaaatattcctggttccagcctgactcttggggcacaattttcccttattctatgggaatggccaggggcttgggaaggaggacatcctccatctgaatctcacttctgcttcctgctgtgacactgcctctcggcctgggctttctcacctgcagagccagcttatgtcaccctcctttgcagcacaggtgtaacaccccagctctgagcctgggccagggaggtggccagtcaacaggcatttattgtgcacctgctgtgtgccctgcatggccccaggtgctgcagacactgctgcggaaagaacggcctctacagaggtttatctgtgcctttcccctacacctcctgtccaggctccagtagcaggaatcaggtccccaagatttcagggtcaactggagaaaaagcaggagggtccccagtgattcaagctatcactgggaggggcccacgatgctgagctttgagaacagtgcttgtgggaggctggactgtgtgagtgcctctgggcactgatcgtttgatcctcccagtgaggcagcccccatcttccagacgggcacactgaggcacagagaagtcagggcacagcctgtttgcgcacagcctgtgatctgggggctggaagcacaaagatatttccaagatcctgggtcagttcaagcagggactaggggcagatgataagcccactcacagtaccaagaagcagggtttaggggagactgggaattggaaaaggcttttcagaaggggtcaatcagaaagcggcaggagagattcccgaggcacccacagcacacacaaaggccctgaggcaggaacagaggggccacaggccacagcacacacaaaggccctgaggcaggaacataggggccacaggccacagcacacacaaaggccctgaggcaggaacagaggggccacaggccacagcacacgcaaaggccctgaggcaggaacagaggggccacaggggctgagcggggtgacactaatccctcagagatgaccgggtgtctggatttagtgcaggtctttcaaaagcaaactgataaattcctccaagggttccagatgcgtttaatctttttttttttttttaattccaattacagggaaagctttgtgttattatggatgaggctggggtagctcttggcggttttaccttttcgaggcatcccaggcccgatagagacagcagtggatgttttaaatctctttttaattaaggaaaaagccctagcttgcgtcagggatgagctgctggagagagacaacctgagaggagctagagacaggagcttcgacacaccaaggtgggggaaggtgcccagccgcctggctctgcccagccaaaccacattcctgccctgggcactgactgcacttcctccctcctgggcagccctcccagttcccgtggtctgttcctgctcatcctagcactgggcgctctgggaaggctgtggagggtgtaggtacagtgtggtgagcccagattccaaaggccaggtccagggtcgggcacagtgactcatgcctgtaattccagcactttggaaggacaaggacaaaggattgcttgagcccagcaattctgttcaagacaggcctggacaacatagcaagaccccatctctaaaaaaatttttttttaaattagccagatgtggtgatgtgcacctgtagtcccagctacctgggaggctgagaagggaggattgcttgagcccaggagtttaaggttacagtgagctgcaatcacaccacggcaccccagcctgggcaagagagatcctgcctcaaaaaaaaaaaaaaaaaaaagcggttgggggtggcgctgggcgtggcggctcatgcttgtaatcccagcactttgggaggccgaggcgggtggatcacttgagggcaggagttcgataccagcctggccaacatggtgaaaactcatctctactaaaaatacaaaaagaattagccagccgtggtggtgggcacctgtaatcccagctacttgggaggctgaggcacgagaatcacttgaacccaggaggcagaggttgcagtgaaccaagatcgcgccactgcaccctagcctaggcaataagagcaaaactctgtctccaaagaaaagaaaaaaatgaagcccaggtccagcccttgctccatcacttcccagcagtgtcccctcctccagccttcaatctactcatccctaaaatggaaacaagagcaggacaaccatgagaacaaaaaaaaaagccacgtacttggcaccctgcctggccacggaaacactcgtgtgtgacccagggtcccctagccttggcgctgctaacactttggtcattctctgcggtggggctgtcctgtgtgtcaggcaatgtttagcagtgtccctggcctctagaccctgtagcacccccagcttctatgaccaaaaatacttccagacattgccaactgtccctggagggcagggtcaccaggtaaaatgcgggccttccatcgcatttgaatctcaggttaacaaatagtttttttagtagaggcatgtcccatgcaatgcttgggacatgcttctacttgacagtattccttatctgaaattcatatataactgggcatcctgtttttatgttattttcctcctcaatctggcagctctacatggggctgtcgggggagcaggcccgtcacccacggtcttcaaagacaggggtaattgtcattcactgcaacaataactgggcatttcagggctggcgctggcactcctggcatggagctgctggcttcctctgtccccatgtggtcccagtgcctggggctacacggaggggctccaggatggcccaagccagaggaacccaagcccccagtctgcccttgacctgctgtgtggtctgaacaagtttcttaccctctctgtcacctactgcaaagggggttatcagcgctaacaattgctacacacagttagccttctcattggaatagagattctaaccttttttttttttttttttttttttttaaagaaatggtggtcttgctatgttgccaggtggaactcaaacttctgggctcacgcggtcttgctgccttggcctgctaactcctgcgctcaggtgatcttcctgcttgggccccctaagtaagctgggattctaggtgtgagccactgtgcccagctctgactgtaacttttgccctagataataacctgtatactgcagtgctgtcataaggatgcatggtactaagaggaaggtgtcgaatggcaggcacttagtcaggccatataattagcaccattattactgctttggaaggagtagtataagcaggccgattccagttagtaccagagaaaggtggtgaacgttgctacttgagcgaactgggagtatcccaggggaacatgggccctgtgggcagctgaagctgggaaaggccgcagccagagagcggagcagactgaaggctgggctggatttgcagctccaggtaggagcaacattcaggagcggaagcggcaccaagcactgtcactcccagctcaggtccagccactctgcaaggtgagctctccggggagtcctggctcccgctgagtgggcccagggccccaggactgccttgctctgctcgctccctgatcagggaccaggactttcctggactccgacagcagcaacatgctttgggacccggcctatgttgcccaggcaacctcagcgaatcttacagaggggctcactgctgacgggaaagccccggcccagggccccaggagctgctggccccagtgttgagaagagacaagtgcagtgacaggtccctcagcacgttctatgaacgcctatgtgcaccaggcgccacggtgccagtgccttcacaggacttggctcctgaaatgatctaaacagcccctggtgttatcccgcccagctcatcctggaagacacggaggcgaaaagaggttgagccacttgcccaagatcacacagctaatttcaggctcatgcctgaaatcccagcactttgggaggctgaggcaagtaggtcacctgaggtcaggaattgaagaccagcctggcaaacatgatgaaaccctgtttctactaaaaacacaaaaaattagccaggtgtggtggtgcatgcctgtaatcccagctacttgggaggctgaggcaggagaatcacttgaacccaggaggtggaggctgcagtgagctgagatcgcaccactgtactccagcctgggcaacagagcaagactccatctcaaaaaaaaaaaaaaaaaaaaaggccaggtgcagtggcacatgcctgtaatcccagcactttgggaggccgaggaaggaggacaacttgaggccagccaggcatttgaagccagcctgggcaacatagcaagatcccatctgtactaaaaaaaaaaaaaaagttaaatgcttcctgttaaaaacagaggaagcatgaacttctcctgaggtaccatttttcacccaacagattggcaaaaacgggaaagctgttaacgctatggccacggtcatctcccatggggtgagtggaaggggctgctggtgtgacttcagggggttcactggcaaagctgtcaaaatgtgaagggtacacaccctccaaccatctagaatgttccaccctaggccaccttctgagtggatggtagaaggatatttactgaagtcctgcttgggcaaggcaggccggatttgggttcgagggtggtggggcgtgcacgtagccgtgctgtgcagctgtgggaaagggtgggcagtactgtggggctgacaggagccatccctggtgtgtgctgttgggtgacaaaaacagggcacaagagcaggctgcccctgcccagacacacatctgctctctggaaaccaggcccctgggagggcagccgcgatgccctggcccaggataactaggctggtctgctcccgtgcccggccatgtccagcagctggtaattggtcaacactgccctaacttccttcgattttttttttcttttttttcagagacagggtctcactctgttgcccaggctggaatgcagtggcaccgggctacgtttattttgtagaaatggggtctcactaatattgcccaggctggtctcaagcaatcctcctgccttggcctcccaaagtgctgggattacaagtgtgtgccactgcacctggcccgctctgacttccgagtcttgagcaacacaaagccagggagacccccggtgggaccgtgagtcccagcacctccccatccctctgtctccctggaggctcattcctcacctttgtccatcccacagatacttctagagcacgtggtgcaggccaggccctaaggaaactgcagggaacgagggggaggctctgtctggactctggacttgctgggttgggttgtgttcctgaggcccctagggatccagctcggccatactctggctgggtgacctcaggtgggagctttaccacctgacacctcagcttctgtatctacagtggggacagtggacagcacggaagccttgctgtgcggatgaaaggagatggagggaaagagctgaacctgcctggtgaggtgtgagctttgggagcgctgagctccctgtgggatgatgggaatgacggggatgacggggatgatgggaatcatggggatgacgaggataatggggatgacagggcagccaccccggccggcgggagggtcagtccgaggagggtctccatatggtgcctaaggctgagagcacattcattctgcaaacatttgttgcgtggtctgtgtgtgccaagtcttgggccaggtgccagggctacagggatcaaaaagacagcgtggttcctgacctcacggatccaggagtgtgaggaggagaacatccttgggaactatcacccgaatactaacacagagtgctggggtgtagaccagccaggctgaccttcccaggcacggctggaaatggcgcttcgtctcccacctgctggcctccctcctttcggaggatatcaggtgccggaggtttagcttaagcatgggtgactgatgggggggggaccggctaagtccctgctgtaagccaggaggggtgcccgctctgccctgggcagggggcggggcgagatcagacgccatctgctccctcgtttaaaacaggctttgatgatccaccccactgccctgagccgaagggaggctggagtggggtgtctctcaggagctcctgcctcctgggcagagatctgttcagaaggttccagaaagagccctggaattgagcctgcacacctgggttcccagccaggctgacttgctccttgttaacttgggcagccagtccccaccgcagccccatctggaaggcaaggacattggctgtcagcctggaccacccaggggaatcacctaggaggcctcctagagcaccagtgcctgggacccatccacaccaatctcatcccaacctctggggaatgggcagtggctgcatccatttggaagccttccagaagattctgatgtgggtggaggtttagactcctgggctagaatgattccagtgctttgtatttcttcttttttgagacagggtcttgctctgttgccaggctggagtgcagtggttttggcaatttggcaaaatttggcaattttggctcactgcaacttccatctcctgggctcaagcaatcctcacacctcagcctcctgagtagctggcactacaggcgcatgctaccacacccaactaatgtttctattctttgtagagatggggtttcaccacgttgcccagactggtctcaaactcctgacctcaagcaatctgcccaccttggctttccgaagtgctggcctgtattaccgcacctggcctgtattactctgaagttctcaatccacacctcagcttctatcacctgctggccccagggacctcagctcctccagctcagcccggcctccatacctgcctcctcgctgctcaccagctcagtgtgcttggtcctgactcagggcctttgcatttgctgttccttctgcctggaacactgttccctgcatccacatggctaactccagtgtcggcaccacagagaacccctcaccttgcctcatcccctcgactgcacctccttgctcaattcccttcacagcactcaccacgaaatccagcctgctgggtgtgtgtttgttcacacacaccattccacatttccgtctctcccccatggacaggagctctgtgctgctcactgctgcatcccgagggctgagtgtgctgcctggcatgcagcaggtactcagtacatgtttgtgtggagttgcccgggacacactctcctctgggctctgtcccgcactggaagggaaccagcaccatggaacagcgactgtgcgttggctcctgttcgcagcttgggtgtggaggtcagcagagtagacaaagacccctggaacatggcggtggcaatggcaggcagtgggtgaggacctcccccaggatccccgcaggcaggagcctgagcccattttacagacagggacaggaaagctcagggaagtggggtgcttgaccttggctattttctaactcctggttcagcggggactggattccaccatgtgatctcccttcaaatgtatgaaatttccagtttgttctgaacactgctgaaatgtattagtggaatgaacgtttttctcaccctcccatttcacagagctcctgtccccagggatggaaactccacattccctgcctggctccacctggctgctaccatcctctccggcgttgtggcccctccagttcctccaccatgcacgccaggctgctgcttgcttcccagcccgtgcccatgagtttctgctaccggaaacagccaccccttccccgctctgtgccaggccagctctttaggctggggtgcttcctgggtgatgccacccctagccaccccgggtaggcaggtgctagcttccatccagcactgagttagcattaaggtcactcctcacctctgtacactcccagtggccaggaccacactgccttgttcatccctgtagccccggcacctgggccagcgcccagtgcacggtagggacgcaataaacgtttgtggagggaacaatctctcacgcaattctggcctgcagctgtccgccagcagagccaggcattcacactgtcacggggccatatggagggattctgggttttgggttgaccaggggctagacgcaagcctctgaaggcaaatcagaaaaatgggtatcataacggccaaccaccaatcaaccccaggctgagccccccgagcgagggagtcacagccatgcctggcagcctggggtccccacaaaaacgaggagtgtctgagaaactgtcacagccaagagcctaaggaggtatgacaactaaatatcatgtgggatcctgcgacagaaaaaatacatgggggaaatcggaatcacgtggacattcattaataataacagatctggccgggtgcggtggctcacgcctgtaatcccagcactttggcaggttgaggcaggaggatagcttgagcccaggagttcaagaccaacctgcgcaacatggtaaaacttccatctctactaaaaatgcaaaaaaaataagccgggtgtggtgcctcttgcctgtagtcctagctacttgggaggctgaggtgggagaatcgcttgatcccaggaggtggaggttgcagtgagctgaggttgtgccgctgcactccagcctgggcaacagagccaggccctgtttcaaaaaaacaaaaagtgtggatattagttaataagaatggatctggccgggtgcggtggctcatgcctgaaatcctagcaccttgggaggtccaggcttgaagccaagactttaagactagcccgagcaacaaagcgagaccccttctctacaaaaaaaaaaaaaaaaaaaaaaaaattagctgggcgtggtgttgtacacctatactccagctgcttgggaggctgaggcaggagaaccacttgagccccagagatcaaggctgcagtgacttgtgatggtaccactgcactccagcctgagcaacagagggagagtgagatcctgtctcaaaaatataaataaataagcacagaaataaataaaacactaataaataaataacaatggatttgtattgattggtttgctgtaacgagtggaccgtgtgagtgtaagttgttcataacagcggaatctggtgtggggtgtgtgggaactctctgtactatcttttcaatttttctgtaaattaaaactgtcctaaaaaataaagtctaattaaaaaaacaatgacaaactaccaacccaggacaaagccttcatctttcccaccaagccccaggcagccccaagggaccttccccaggacagttgctgggaccagtctcattcccaggagcctgtatccatggtgacactggagttaacccaggctggagctgacgcccaccccgcccccacagaacctcacagatcacaggggtcctcccaggtagccctaacgccccagccagccactctagtgggaaagcccatgcctgcagtttaagtcttcctgcagaggcccccgcacacctgcagccacctccatagcaggaaggtgtaacggctccttgggtgccatctttagtgcctatctcagaaaactctcgagacctgacccaggagatcttcccagtcaccactccattttacagacacagaaactgaggcctgggcacgggaagtgacttgcacaacgttgcagtcagtcagaggcagacccagaatatgaactcggatctctgaccccagagccactttgccagtggtcctcaaagttacacagccactggaatccccccggaggatgtgttgaaaaccctgagttcctgactcagttgatccagtgggtcctgagaatctgatggtctgactggttcctaagtgatgcctatacagaaggtcccggaccccactgagaaccatgcagcaggaccatgccatttccttggctgtgccgccctgctggaacctggagagggcgcacttaggaaccaaggagacgactccccctttccccttccgtctgtggagccaacccctcctaactggccatgtggccttgagccagtgagaggtcccctgtgcctcagcctccctgtctgtagagttcagcagtgatgagggtgccatgcccagatcctgttgatgccagcacgtgccaacccttatagggtgaggcacgagggagattttctttggcctgtgggacactcccgtgggtcacagtcaccatggccaggcccttgagcagagggactctgcagcccctttcctttggactcggaaacaaaggggtgttggcacagctgtgttcctcctatgccaccctctcaatatctaccacccttgggcagagtctttgttgccagacaggagaagcacattcctgccccccacaggggaagctcagaggtgaactgacttaatgggggctgaatagtgtcccccaaattcacatcaacccagaacctcagaatatgaccttatttggaaatgaggtctttgccgatgtaattagttaaggatctcatgatgagctcatcctggatttgggggcggaggggctctaaatccaatgcctggtgtccttacaagaggaggagagggaggttgaatgcagggcaacatgaagagaggaaggccacgtgaagacagaggcagagactggacccaggaggcctgaagctatcagaagctggaagaggcaggaaggttcctcctttggcgctgaggagggagggcggccctgccagggccgatttcagaacaatgagagaataaaaattgctgttttaagccccccagcgtggtcatttgtcacagcagccaccggacagtcacgcacggtagagatggaagccagcccagcagtgggcagatcccatcccagccagccaagtcgggtgccatcgacacaaagccagcccaatagggaaggggcctgtgtcttcctgggcagttacacagcctcagagcccctgggggagctgaggaaggaggaggtggcgagggctggggctgtggctggtcagagcgggtgagatgaagcccgcagggaagaacgtcatacccactgtgaccctcacactctgctgagtgggttcagcccatgcctcccgtaaccacgcctccaaagggaataagaacgggtctcggagctgcctccctagaggagcccatgtctcatttctagttggtgtgactgtagctggtcacttcctctccttggtcctcaacttccctatctgtaatgtaaggctttgcaagatgagtgccaaggtgcctcccggctcagaaagcctactttggttctagagggagagattcccagactggaggggaagggaaaggagggcagcaaactaaatcccccagaccaggcaagtgaacccccacatcagccgagggaacccccagaccagccactgaacccccacatcagccaactgaacccccagaccacacaactaaacccccagaccagccaactaaacccccaagaccagccaagtaaccccagtccagccaactgaacccccagattagccaattaacccccatacaagacaggtaaaccctcttagaccagccaaccaagcccccaagaccagccaagtaaagcctccagcccagccaagtaactcccagaccagacaacttaaaccccatagatcagccaactaaccaactcccccatacgagacaaccccccaagaccagacaacaaaatcccccaaaccacaaacctaaatcccctagacaactgaacccccccagatcagctgactgaacctcccagaccagtgaactggaccccactcattaaaatgatgtttggaatatactgaattaaataaaacatattaaaagtaatcgtacccgtttctttgtaccttattcatgggactgctagaaacgtcaaaatctatttctactggatggtgtggctctagatagtatgtccttgagcagagtcctgtctttatgattcttcaagtcctctccagaacccagcactcaataaaacctgtgggctggatgcaggatgcctcagtttaccccagaggaagctgaggcctagagagacaaggtcacttgccctaaggcaggaaccactgtgtaatttgtggggctcagtggaaaacgaacatgtgaggcccattgttcaatatgtattaagagcattaaactgagcatggggccctgtgcagctgcagaggtcacatgcctgtgaagctggccctgctccaaggccaaatcgttaaggggcagagctgggatttgaacccagggaggcctggagctgggggcatggtacaggagggtcacctggaaacaggtgggtgggtctgagtccctgggccaggctgcggggctagagcagaggggcagagggcctgggtcctggcgggtccctcctcctggtgccctgggcagcgtgtagtgttgaggccccagggagtgagagtaatcgtatccagggctgaacggtgcccgctccaaaagatacacctaaccggagcctgtgagtgggaatctgacattgttgaaaacaggatctttgtgatgtcattttttttttttttgagacagggtctggctctgtcacccaggctggagtgcagtggtgtgatcacagctcactgcagccttgacttcctgggctcaagggatcctcccacctccgcctcccaagtggctgggactgcaggcatgaaatgccaccattccctgataatttttgtattttttgtagggatggggttttgcaatgttgcccagactggtcttgaactcctgggctcaagagatcctcctgcctcagtttcccaaagtgttgggactacaggcatgggccaccgtgcagccccgcagatgtaattgagttaaggatcttgggatgacattatcctggactagggtgggtgctaaagcaaatgacagttgtccttaaaagagaagggaagacagaagaggaaagccatgtgccacaaggcagaggctggagctaagcccacaaaccaaagaatggctggtgccaccaggagcttggcaggaaggagcctccttagagcttccagaagaaacgaggccctgctcacacctggatgtcacacctctggcctccagaactgtgagagaataaattcctcttttaagccacctagtttggggtcatctcttacggcagccctaggacagtaagaccccatgttacagagttcctggctacttcaaatatggagttaaaatgattctctctgggccaggtgtggtggctcacgcctgtaatcccagcactttgggaggctgaggcaggaggatcacttgaggtcaggagttcaagaccagcctggacaacatggtgaaaccccgtctctactaaaaatacaaaaattagctgggcgtggtggcacacgcctgtaatcccagctactcaggaggctgaggcaggagaattgcttgaacccgggaggcgggggttgcagtgagtcgagattgcaccactgcactccagcctgggtgacagagcgagactctgtctcaaaaaaaaaaaaaaaaaaaaaaaagagttctggccccctaatccccattccccaagtcacccccatgcttgtgtgggcctcatcacctccagagacccaggctgggcgagtgggggtgggcaggggccggcagcaccaaagccagccatgaaaaatggatggacaagccacactcgggacaggcgctgttccagcacttagcacacttagcagctctggggccgacaggaagacggtccttttaaaagctcccagccccacgagccctgatctggctgcctgtgctttcactcgtgaggggccgagggtgggtggaggtgggagggcatttcccaggcactgtcaggatctgcagggtcttggtctaccttcctgatcaagtcccggccttgggctggaagaaaagtggtcccagagatacctccaggggcctggtttctccgtcaaagatgtcctgacacaatcgccaaaaggtggaaacaacccagtgtccatcgttggagaagtggataaagaaaatgtagtctgtccacatggtggaatattattcagccgtgaaaaggaacgaagcagtgatgcatgttcaatgtggatgagcctagaaaacaccacactgagtgacggagaccagacacaaaaggacaaatgctggatgattccactgacacgaggtccctagagcagattcttagagacaggaagtagaatggtggctgccaagggctggggagggaacggggagttagtgtttaacggggacagagtttcagttggagatgatgaaaccttcattctgaagacgggtggggtgatggttgcacaacactgtgaacgtgcttaatgccactaaccttgtacacttcatggttaaaacggtaagtttatgtgatatatattattttttaaagaagaaaagtatcctcaatgcctactttgtgacaggcactggggaactcatgtctaagggaagaaagtcctcaagtttcaaggggttaggcttgaccctctcaaccactgtctgctgctgaattaacctcagccactcacagatactcattcaacaaacatctccccactcctctgtggggtcagcctggagtctcagaggaagccaggtcctggagaggacgtgggctgtttgtgtctgtccggcatcccatcccgcttagtaaacgacaccccgattttcaccaggggaaccaatctctccgcaagcggtgttggaggagctgtcaatcaagatgcacctccctccaggccaaaggggcgggcctaagacctaaactgggccaatcggatgctctcctggagcggattcctcccagcctgggaatctgaagggtggtccattcatcccggctcccagcaggggccttttcacgcctccttacttcacttttcctgtgggctcccctcggctttccagtaaattccttgttaaccagtatccgcttctgtagcttgcatctaaaagccctaagcctgcctaaacccaaaggatgggctacagagcctggtgaatttgacgaaggaaatagtacaattaattaagagcagccaccgccagagtgttccaggccctgctctcgtgctcccggtgacctgagacgggtccgccatgatccccattttactgataaggaaactgaggcccttgatctaggtctcacagaggcattggtgaggccacaactcacaccatgcaggctgatcccaggcttggctcagctcccaaccacctctccaggtgggtaggtggcctctgcctggaaggggctgctggggtcaggtaggtggccccggggcaggctagaagcttggcactcacaccactggccatgggacacctggagccagaggcggtctcaggcagcggggccgcaagtcagaccaggggccgcccacgtgactcccaggtttttggctggggagaacaaagcaactgtcaccaaggtaaagaagaggggcagcaatggacttgggatgggaggtttcctgcaacattggtctgaggtgccccagggccatccacacacaggacagaagtctgggctgcctttgctaacacccacaacacccttcagtggttttgtgtccttctagaactttctcccgctggccttctctcctaccacctggacgctggacctcctgtctgggtgataacaggccccgggtgtgtccttgggaaagcaaacagcccagcatatgcctggctccttcgcaaaggcctcctcctccctcactctccacagcctgggattaggcaccctgagggggaaactgaggccccaaggcactgccaccttcccagtcacccactgctagtgaaatagaaggcctggaggggtgctcagagtcaggacaagcatttttagagcacctgctgtgtacaggactgctttaagggatggtgccctgctccctctgcagggcagagggcttcaactcccctctctcctgccccccaacccagcaccccctctgccatgagagctggtgggggcagagcttcaggccttacctttcaggcaggacatcttaagccccatgtcggcacctctgcaggcctgtggagagaggacagcgctgagagaggggagggcgcgacttgtttgtattggccacgtgcagccgggcccccacccttggccctgatgagtgcaaaacaggaggttgtggtggagagaaaccaccggcctccaggtcatgccacctgtcaactacatctgggctggatttgctcaaagatggagtctgtgacggtggaaaaaacttacgggtgcctcaaagttaaatatacaggaagccaaggcggcgtctgcagccctggctctgtgaggtcacttgaacccaggaggcggaggctgcagtgaactgatgatggggaaccgacaccaccaagcctttcctttcaagagccacaggacggccgcagctgcagagatgtgaagacctgccagcagggctcgggggtggcccagaggcccccatggccatgtacctcccgttctaatgctttttttttttcccctaatgcaggttctttggagatctgacagcctgagctatagaggacgtgtggcccccccagcccacgggtattagaattgtcccaaccagtgttctcatgatgttcctgcaacatgaggcatcccgagttctaagcaattgaaaaatagaagcagcagccagtggtgcggggcccctgcatgctcttgacactcactcctcagtaacagccccgcaaggtactattactgtccccacttcacagacacaaaaatcagggctcagagaggtggcggcacctgcccaaggctaccagcttactagggactgtggagctgagactcgaacccaggactgtcctaatccctaggctggggccccaccccacaggggcctgtagtgtgcagagatccagaggaagataaagcaacagtccgtgggaggaaccccaggggatgggaggtcaggcaggaacaggtggggagaagccgaagatgggtgggacctggggtttctggggctggtttggagttaagagcttattctgaggacgccaaggagcaagtctgctttctagaggggtgtgtggctagtacctgtgaggagaccccaggcctggccctcatgtgcaggctgttggtggattggtagcatcagcaacccggaggctggggagcaaggcagcagctcaggcccacccaggcgcacaaggccccagggattcctgtgcctgctgaggtcagagatgcttgctctgggccagaaatcggggaggtgaatgtgaagatggcaggccaggaagggtttggaggagaaggagctggaagtccaggtggagctagtaagacatgggtgggagataccaccaagacatagaccggggccttgggaagggagggaaagcgagagatactgatgggaacaggcttgggccagctgcgtatgaaaggcagccattccaacttacgagtggtctctggagcttccccattgcactagctgggccaggtcccagcttggcaactcccagccatgtgatcacggatagtttatctcaagacttcactttcctcatctttaaaatgggatgagctggccgggcacagtggctcacgcctataatcctgacactttgggaggccgaggtgcgtggatcaggagttcaagaccagcctggccaacatggtgaaaccccatctctactaaaaataaaaaaatgagccaggcatggtggtgggtgcttgtaataccggctactcaggaggctgaggcaggagaatcacttgaacccgtaggtggaggttgcagtgagctgagatcgtgccactgcactgcagcctgggcgacagagtgagacttcatctcgagaaaaaaaaaaatgtaaaaaggggtgaggcacataacagtctcattgagcagcagcgagaactgagtgtggggaagtgatctgtgctggggacagaggagaagtccgaacaatgtcagctgctgctgtccctcctgacagagagggagggaaaggaggtcgaggtttccagctaggccttttatccagggccttgctgttcccagaatggcccatggaacagcagcacaggcttcccggtagctgtgcatgcagagtctcaggccctgagctggccctgcccactcagaacctgcatccacactacagccaagaagagctgggcactgcagcctccgcacatcacccaggagctttacaaaataccttttcttccggattaggtaactcgcacctgtcatcccagcacttggggaggctgaggcatgaggatcacttggggccaagagtacaagactaacttgggcaacataagaagaccctgtctctataaaacaagcttacgcctgggcgcggtggctcacgtctgtaatcccagcactttgggaggccgaggtgggcagatcacctgaggtcaggagttcgagagcagcctggccaacatggtgaaaccccatcgctactaaaaatacaaaaaattagctgggtgtggtggtgggtgcctgtaatcccagctactcatgagtcttgggcatgagaatctcttgaacctgggagatggaggttgcagtgaaccaagatcatgccactgcactccagcttgggcaataagagcgaaactccatctcaaaaacaaaaaacaaagaacaagcttgtacaacccgcagccctccagctgcctgcagcccagggtggctttgaatgtggcctaacgcaaatttgtaaattttcttaaaacattatgaattttttttgtgatttttttttttttttttttagctcatcagctgtcattagtgtattttatgcgtggtccaagacaattcttcttccagtgtggcccagggaagccaaaagattggacaccctggctataaaacatttttaaaaaattagtcaagtgtggtggcctgtgcctgtagtcccagctactcaggaggctgaggtgggaggatcacttgagcccaggaggttgagactgcagtgaaccttgatcgtgccacttcacgccagcctgggtgacagcaagagcctgtctcttaaaaacaaaatgctgcttgctgcctgagccccacccccagagattctggggcaattggtctggtgtgtggctggcattgggattttttttttttttttgagacagagtctcactctgttgcccaggctggagtgcagtggcgtgaccttggctcaccacaacctccacttcccaggttcaagtgattctcctgcctcagcctcccgagtagctgggactacaggcgtgcaccatgacacccagctaattttttttttttcatttttagtagaaatgggattttgtcatgttggccaggctggtctcgaactcctgacctcaagtgatccacccacctcggcctcccaaagtgctgggatttcaggtgtgagccaccgcgccgggcccggcactgggatttttaaaagctccctgcaggactctcacatgcaggagagagaatccttccctatgggaggagtgaggggtagcggaggagtggggctggggctgagggacggagggcccaggcctgtgggagcgacaggcacatttcctggcactcaccatgggcccggcactgttcagagccctttatgtgtattcatggttagtgaatcctcactataaccccatgaagttgggaccgttcctgtccccatctcacaggaaacaggcacagagaaattagttaacttgcctaaggtcatctgggtagcaagtgacagaacagggatttgaagccagaactttggactctagagcccacgcttttagtgaccaggcagacctgggaagtcttggagtccccaggggacagagcttccaggaacaggggagggcggagcagacctcatctccatccctcatcaattgtgcccatgctggctctcctgccgccagccttgccaaggggtcctgcagccctgacgtcaggatcaaccacaataagccagagggaaagctgcacagagccccagggcctctgctggccaggcttcccaaacctccctggactgtggctgctggtaagccagactcgacatcccaaccaagcgcagaccggccctgcacaaagtactcggattttatcatctattcccttttatcctgtctttgttcagcattgatcacagcccacccggtggattttgacatgtctcaacccagggtttgaaaaccagtgatctgtacagaagttctcacagaaagaatgatgtctggaatttgctgtaaaatacttcagtaaaacaacaacaacaaaatgctgtggggcacagggaggcgtcaccatgagagcagcgggatgctgtttactgttgagactgggagataggagagcatgacatactggtgtgtttgtttgaaaagtaatgaccagcctgggcaacatggcgaaaccccatctctacaaaaaaatacaaaatttaaccagtcatggtggtgcatgcctgtaacccaagctactcaggagactgaggtaggaggatcgcttgagcctccttgaagtggaggctacagtgagacgtgatggtgtcactgcactacctgggagacagagcaagaccctgtctcaaaaaaagaaaagaagtaataaaacagtcagaagagaaacaactgtattttaggtgacagtctggggtcaatattaagttttctgattctgattattgtactgtgttctgtaagaaatggtccttgctcggccgggcgcagtggctcatgcctgtaatcccagcacttagggaggccgaggcgggtggatcgcctgaggtcaggagttcgagaccagcctggccaacatggtgaaaccccgtctctactaaaaatacaaaaattagccaggcgtggtggcaggcacccgtaatcccagctactcgggaggctgaggcaggagaatcgcttgaacccaggaggcagaggttgtagggagccgagatcacgccattgcacccataggctgggcgacaagaacgagactttgtctcaaaaaaaaaaaaaaaaaaagaaaaagaaatggtccttgctcttagaaaatatacactgatggccaggcatggtggctcacgccttgtaatcctagcactttgggaggctgaggagggcagatcacctgaggtgaggagttcgagaccagcctggccaacatggtgaaaccccatctctctactaaaaatacaaaaaattatccaggtgtggccgggcgcggtggctcacgcctgtaatcccagcactttgggaggctgaggtgggaggatcacgaggtcaggagatcgagaccatcctggctatcacggtgaaaccccgtctctactaaaaatataaaaaattagccaggcgtggtggcgggcccagctactagagacgctgaggcagaagaatggcgtgaacccgggaggcggagcttgcagggagccgagatcgtgccactgcactccagcgtggggcacagagcgagactctgtttcaaaaaaaaaaaaaaaaaaaaaaattatccgggcttggtggcgggcatctgtaatgccagctacctgggagatggaggttttagtgagctgagattgtgccactacactccagcctgggcaagagagtgagaccctcaaaaaaaaaaaaaaaaaaagaaagaaaatatacactgacgtgtctgggctcaagagtcatcatttccgtaacttaactctcaaattgttcagcaggaacatagtgatacgcatgaatacgtgcagggagagatgaggacacgcgtgtaggtaaatgttcatttctggcgaaggatatttgcagggcctcttcatattctcacaactcttctttaactttgaaactgcttcaagaaaaaggcttaaaaaggaaagaaaggcaacatccagaagagacagggcagctcagtgagagtctgcgcaatgcctggcctccccaccatggtctcccagggcaggatgcgggcggcagcatgtgcgtcagatcgcgttttcctgctagcagcttctacagcttggtggagatgcgttcctggggccaggctctggccgagcaaaggatctgtattatgccgtgccaggcagcaccacctccctgaagaggtgtctggaactgacaggttttctctgaacagctgtcttgcaatttgaaagacccctacctcaaaacacacaggggaaggaaggaaggcagggagggaaggagggaagaagcaaaccagaggatgggggaccaggagcagctccagccaggattcaggtgacactgggggcaggatgcagtgagggtcaggcaggtgcagcatcgagggtggtcacgtccacatatggcaatttgatgtggggtgtgtggaactcccacgtggagagttttcacacagcaagttttctcatctcccacagtgtccctgaacttgccctcattgtcatcctgcttctgcctccctccaaggacagcacaaaggcggcaggcacaggactggctgaagggacaagaaagaattgggagtctagaggagctgtgccacctcaagcaggtcatttcccgagtctgaggtgctggggctcggtcccccaggttctgtgtcctcctctgccaaacaggcattgagccaccagcctccaggacagggcctgggacagagttgtcaccatcatcttcatcatcatcattgttctcatcattcttattgctatagtttggatatttgtcccttccaaacctcatgttgaaatttgattcagaacactgggcctgatgggaggtgtctgggtcatggggcaatctctcatgaacagcttgcttggtgccgtcctcacagtaatggatgagttcgctccctattggttcctgcaagagctggctgttaaaaagaagcctggtggctgggcgtggtggctcacgcctgtaatcctagcactgtgggaggctgaggtggctggatcacttgaggtcaggagtttgagaccagcctggccaacatggcaaaaccccgtctctactaaaagtacaaaaattagctggctatgatggtgcatgcctgtaatcccagttactcaggaggctgaagaatgagaatcgcttgaacctgggagccagaagttgcagtgagccgagatcatgccactgcactccatcctgggtgacagagcgagactccgtctcagaaaaaataaaagagcctggcaccttccctgcttcccacttgctgccaccctctcgccacatgatctctgtggctccccttcaccttccgccttgagtggaagcagcctgaggccctcaccatcctggcgccatgtttcttgtccagcatgcagaactgtgagccaaatgaaacttttttttttggagacacactttcactctttttgcccaggctagactgcaatggtgcgatctcggctcactgcaacctccgcctcctgggttcaagcgattctcctgacttagcctcccgagtagctgggattacaggcatgcgccaccacacccggctaattttgtatttttagtagagatggggtttttccatgttaatcaggctagtcttgaactcccaacctcaggtgatccgcctgcctcagcctcccaaagtgctgggattacaggcgtgagccacggtgcccagcatgaacctcttttctttataaattatccagccttgggtattcctttgcagcaacacaaatggactaagacaggtgtcacctcactactgttgtcatccttgtcactgtcatcattgttgctgccacctttaccatcatcatcctcatcatcgtcatcagtgtgattgccactaggtaccaccagggcacccccactacgtggccccaattccacagtgtggcctgttgtgttgggggtgaatttatgtgggagtgtggagagccctgtccactccctttgagatctggggccagcctcctgcagagaccacagatgctttcatgcgagaggccccttagatgagctgaaatgtctgagaaggaggagttacagctttgattctacatctgtctgaatagaagccatacagttgtctaaacatagggaagagccactgttaccttaaactttatcatcatcgtcatgacaatatcagctgatagatatccagctgttttcagtgtgccaaattctgggccaagtttgctataaaaacgatgccactgaaccctaacaatgccctaagagataaacattatcaccatcctgttttataaatgaggagctggggctcacagctgtccagcgactcccagcacccagggctagcaagctacagctctgggctgccagacactaaagccaagcccacatcactgcactgggttgcagtgttctattccacacgccagaattctagattgtttgagtttgttacaaacacacgtatctttgtaactagaaaataaagatttaaggccggacgcagtggctcaagcctgtaatcccagcactttgggaggctgaggcgagcagatcacctgaggtcaggagttccagaccagcctggccaacacggagaaaccctgtctctactaaaaatacaaaattgggctgggcgcggtggctcacatctgtaatcccagcactttgggaggccgaggcgggcggatcacgagatcaggagatcgagacaatcctggctaacacagtgaaaccccgtctctactaaaaatacaaaaaaattagccgggcatggtgttgggcgcctgtagtcccagctactcgggacgctgaggcaggagaacggtgagaacccaggaggcggagcttgcaatgagtcgagattgtgccactgcacaccaggctgagcgacagagcgagactccatctcaaaagaaaaaaaaaatacaaaattagccgggcatggtggtgcatgcctataatcccagctactcaggaggctgaggaaggagaattgcttgaacctgggaggcggaggtagcggtgagccgagattgcgccattgcactccagcctgggcaacaagagcaaaactccgtctcaaaaaaaaaaaaaaaaaaaaaagaaaagaaaagaaaaagaaaataaaataaagatttaatgggagaaaaaaagatttaaggcaaggatacccttagcttggcatgatggtatgggagcagttgggcccaaaagaactgctagtttaggtataaatgttctatctttttcacacatttgcaggggtgtgaaaaacttccgtttcatattgaattgggctctgtttatgttcccgttgaaatatcagattgttaattatttgcacaacagcttgaagaagaacaggttctttcttgcacccaggcataaaaatctccctgtcagcagccagatgcggtggctcatgcctgaaatcccagcactttgggaggccaaggcgggcggatcacgaggtcaggagatcgagaccatcctggctaacacggtgaaaccctgtctctactaaaaatacaaaaaattagtcaggcatggtggcaggcgcctgtagtctcagctacttgggaggctgaggcaggagaatggtgtcagcccacgaggcagagcttgcagtgagccgagatcgtgccactgcactccagcctgggcaacagagcaagactccatctcaaaaaaaaaaaaaaaaaaaaactctccgtcagccgggtgcagtggtttacgcctgtaataccatcactttgggaggccgaggtgggcggatcacctgaggttgggagttcaagaccagcctgaccaacatgcagaaagcccatctctactaaaaatacaaaattagccaggcattgtggcgcacgcctgtaatcccagctactcgggaggctgaggcaggagaatcgcttgaacctgggagctgcaggttgtggagagctgagattccaccattgcactccagcctgggcaacaagacgaaactctgtctaaaaaaaaaaaaaaaaaaaaaaaaaaaaatctccctgtcgccaaatggtcacggattctctctggtgacaaggatgggcaatgggcaattataaaaactgacttcctcggcagaggtccaccccctcctgaggggtggcaagacagacagacatcagatgtcatgcatgccacacagcttctctaaggccaagagcatctccagggacaggtcccacttccatgttggctgtgtttgtttttgcaacagccttgaaggcaggtgccacaaattaccagctcacaacagactgcttgtcagcttgccctctacagattttcagtgcaaacagaaaagcaaaatgatgtgttctttcataaagtcaaaagcaaccaagacatagcactgactgtgagggacagaaactcctgctggctggagggaccctgcttttcaaagacagagaatctcccgctggctgagggaccctgctcactgcctaccagagacagaatctcccgctggctggagggaccctgcttttcaaagacacagaatctcccgctggctggagggaccctgcttttcaaagacagagaatctcccgctgactgagggaccctgctcactgcctaccagagacagaatctcccgctggctggagggaccctgctttccaaagacacagaatctcccgctggctggagggaccctgcttttcaaagtgggctccaacgtttgccgattcccttcagttaccacttgtgtggatcacagaagttcagctctaggctatgagataaacccatcctggagaggctcatagaaatctagagctggaagtggtcagagagagatggccaggtaaaatacaggatgcccagttattgcatgggacacactcataaaaactattcattgtttatctgcagttaaacttagctggggctgggtgcggtggctcattcctgtcatcccagcactttgggaggatgaggcggcaggcagatcacttgaggctgggcgttcaagaccagcctggccaacatgatgacaccccgtctctactaaaaatacaaaaattaactgggcatggcagagggcgcctgtaatcccagctactagggaggccgaggcaggagaatcgcttgaacttgggagacagaggctgcagctagtggagatcgcgccactgcactcaagcctgggcggcaaggtgagactcgcctcaaacaaacaaacaaaaacaacaacaaaaacttagctggataacttagttatccttgtgtttatctgctgaatctgaccactctattcaaggtcatctgatttctaacgtctggctgtcccagatggggacctggagaactagacagggaaagtgaatgaactggttcctgcagagccacctcccagatgaaatcagagtaaccccatggaggtcctgagtcacggtggcaccttgccctgcttgcctaacaaagacctcctgggaggaggacccagaagagggcagggctgaagaagagtcacagctgaagaatgtgactgtttgccaggtgagtgggctccaatcccagtggggcagggtggtctctgaggcttggtaagccccttcagctctctgggcctggtcatgctgcaagcagggaagagagtgcgggcaagcggggctcccagcaggctcacgacacacatggtgcttttcttccttctttaggaaagccactttctttctgcagcaggattagaattcctacaactccagccaaaggaactgggttgggaagcgatactgcaagcattcatgtgcttccatcctggtcttcagcttagccacggtcctgcggggacagtgagtccctctctgagtggccaggacctccacctggcccacaggaagccttcaccagcaggaagcgaaacaggatggggtggaggcaggaggcccaccgaaatccccacctgcttggcctcccacggatgagccgtgtgactcacagcaaaatacttgcccattgccgactctgggccaccgtgaaataatagagctgaacacctttaggatttgagcacctttctgtacattatacatcaataaaaacatttatcaaaaaataagagggctttgagaccagccagagcaatatggtgaaatcctgtctccacagaaaaatacaaaaattagctgggtatggtggcacacacctgtggtcccaactacttggggggctgagttgggaggatcacctgagcccaggaggttgaggctgcagtgagccatgatcatgccactgcactccagcctgggcaacagagagaccccatctcaaaataaataaaaggggtctgctatttgaagtcaggttaacggctacccatagggaaaccatggctgggaggagcatgaagggatttctgggggtgtcctggggggctgaaggtctctttcttgacctggtgcacacttttgatgtacacttattacaatgggcatatcatcttgcccacaaaaagtatcaaactgtaaaatatttgaagagatttattctgagtcaaatgtgagtgaccaatggcctcaggagacccagagaatatgtgcccaaggtagttggtctacagcttggttttatacattaggaagacacaaggtatcaatcagtacatacaagatatacattggttccagctgggcgcaaggactcatgcctgtaatcccagcactttgggaggctcaggcaggtggatcacaaggtcagcagttcaagaccagcctggccaacttggtgaaaccccatctctactaaaaatacaaaaaaattagccaggtgtggcacaggtgcctgtaatcccagctactcaggaggttgaggtagagaattgcttgaacctaggaggtagaggttgcagtgagctggtattgcaccactgcactccagcctgggtgacagagcgagactccgtctcaaaaaaatatatatatatatacatatatatatatgtgtgtgtgtatatatatatgtgtgtgtatatatatatatgtgtatatatatatatatacacatacatacattggtttcatctggaaaggtgggacaactgaagggggaagtacgtgggatggggagacatggcttttgggtcataggaggattcaaaaattttctgattggcaaatggttgagagagttattatctgggctgggtgcagtggctcacgcctgtaattccagcaatttgggaggctgaggtgagtggatcacgaggtcaggagtttgaggccagcctgaccaacagggcgaaaccccatctctactaaaaatacaaaaattagccgggcatggtggcacgcacctgtaatcccagctactcaggatgctgaggcaggagaatcacttgagcctgggaggcggaggttgcagtgagccgagatcacgccactgcactccagcctgggtgacagagcaagactgtctcaagaaaaaacaacaaaaaaacccaaaagagttattatctaaagacctggaatccatagaaaggaatgtctgggttacgataaggagtttggcttgagagagaacagattgtacatgtttcttatcagacttaaagggactgtcctattagtctgaaggtctgcactgatgttaatgctggtctgcggggtctcaatttcaaaaggcaagagagtataatgaggcatgtctgaccccacttctcatcatggcctgaactagctttgcaggttaactctggaatgcccttagccaaggggagtggtccattcagatgattgggaggctttgattttttttttttttttttttttattttatttttttttagagaaaggagtctcactatgttgctcaggttggtctcaaactcctggcctcaggtgatgctcgtgcctcaccctcccaaagcactgggatcacaggtgtgagccactgtgcctgggccccatcatcacttactaatctttttaatgatgggggattatacttagcaggcccagaggcctagcctggcttccactgcaggtaagagcaattcagtaccacggctcagggttccaggcctggccttgccattttccagccatgtaaccttgtgtcagtgactttgcctttacaagcttctgtttcctcatttttattttttaatttattattatttttttaagagacagggtctccctctgttgcccaggctggaatgcagtggcgtgatcatagctcactgtagcctcaacttcttgggctcaaggaaacctcccgtctcagcctcctaagtagctgggactacaggtatgcaccacacccagctcattaaaaaatttttagtagctggggggactcactgtgttgcccaggctggtctcgaactcctggcctcaagcactcctcctgctttggcatcccaaagtattgcagccacaggcgtgagccactgtgcctggccctgtttcctcatctttaaaatggggctgacagtatttggttggagagttggtcaggggattaaaacagaaaacgcagggtctggtgcatgaggagtgctccgtaagcatgaactatcagtgcgctcttcttcagtgtccactgacggcacgctcccatttcaagtctccagaggtgacctgcaccttgggctgggaaaatacactctacgtgggtctggggtgcaccccaccggcatgggaaggcgcttccagggagacgagattaggtggtgagctttcagcctccttggggctggtgagggattaagtgtttccataaatacacggcctcctcccatccacaggaccgggtccccagcggtgggggcgcagaacccaaggagggcgtggcctgcacaggtgagggtgctttttggagttaacccagcccaggacaggggcctccccacagcgttggatgggtggggtctaggcaggaaacgccagagcctgtgactcagggtatccctctcagagcctcagtttcctaacctgtacattgaggcgttcgttccccgagaaccgcactacctcacaagtgcctttgcctcgcagccttcccttcctccctcttcctccgggctccaaagcctgtcgagcctgcacagattttcccttgattccatctgggccccgcagccggaggcggtctgagagaagtcccagccgccctcagaccccgccctccgcctatccctggggggagctgcgggtgcccctttttactgagacctcccctagttccgctcgagcgcagccagccaggagaaggagcgcgtgcgtccacacgggtcgcccttcgcggttgcaaacctgctttgatgccctgggagcgcaggggggcccctaagtgaggcagttcataaataatagatttggaaatactcgatagagtggaaatggttcctcgggaggcctcctgcccccgccccccgccgggctgccttccagctctcaggaatggcgttctggtccattcccaaggaactcgtgacggcgcggggtggcctgtggtgagtggggggccagaggcttccgcgcggggtcacacccccaccgccgtgcaagttgcagcgcggccagagccgggccaagtttcccaaagcccgtgtctccgcagcaaagtctgcaagaagttggggggacgcccgggcccgcgtgggtctcccaccgacccccgggccgcgcccctgcagcggctagagcttgcgaggcgtggacgccgcccggccggggccgcgttgctcggggaaggcgggcgtcccggggaaggggcggcgggcacgaggcgcggggcactcaccgcttccttcttggtgggctcactgcggagccgcgcccgaggcgcgcgaggcccgcccgggcgctggtggtggtggcggcggcggtcgggctcggggggccgcggcgacgagcctgcaagacagagcagcgggggtcatggcccggccggcgctcggg

SEQ ID NO: 2247 - DNA, 81 bp, Homo sapiens
cttgccctcattgtcatcctgcttctgcctccctccaaggacagcacaaaggcggcaggcacaggactggctgaagggaca

SEQ ID NO: 2248 - DNA, 164678 bp, Homo sapiens
tggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaatttaaataacagtagccgctgccctccctgcaactagggcatgagaccctggaactgagcgaggcggtgtgtttctcatgcccttcccacccaagtcatgcgcaacgctaggcgcacactggacgtgctcaagaaatactttttcaacctcagcaatagatgggctcaggggcgagaggtttcagccaacagcatgacagagaagggctctgctgccactagcacagctgtgacaggtgaggaggcccgggacactcaccgctcggtggcctccggtagctggcaggcccgggcgcggcacagccgctgtgcgcgatggggcagtgcgagaggttgcagttgcgggcgccagccgaggcacaggtgatcacggagggccggttctgcggggaggaggggtgtcagtatgtggagaccagcttcagtaccgggcaccacccctggggccctccccagcacccttcaggctctgtcctggtgcccttcctgacccagtctgccacctcccacttcaatactggagtcctgttgctaaacacagccaatccacagagtgagcgcagctccaagggtgtgtgtagtggcccttggtcgtggctgtttggatcagtgagggtacaaaggacaaaagctcaactgttgagttggtctgtccccatctctcaaatctgttaagacaaacaccgggcatcctgtggaggacagagggttgcaggagggacctcgattctcccgttaacgtccccagagcccttcccatcatgtccactgagccgcgggtgtgcctggagccatccaggacacttcaatacacggcaattaactggaagcattttgcttgagccaaagccagctcgagttggcctcagtgatgacctacaaatcgggacagagaggaaatggaggaaatatgcctaagtgtggaacggcacacatcccaccccagcccgatctgccctgtgcacagcctcactctctccttcacccccacccccacgctgtctgcctggcaaactccccttgttccttcaagccctgttcagatctctctctgaagcctttcactggccaccgccccaccaccaccgcttttcactcctgctcccctaacccaccaagattcagcaagtgcatcggtctgtccaggtgctcccgtaagaccatgcacaccaggcagtatgtctggccccccagctttggtgtggaacctgggacagaaaatatttgtgaactaaacagaacttcctcaggttcccccaggaaaagtatcttccaatacccccgaggacaaggtggtggagtatgtgggctaagttccaggacagccagcaaggagctggttgaaatcaccccacagggaccaatggtgacagcagtgtcagccagagggacgctgggccttatcctccccagccagccctttccattaaagttagagcagtagctggtataaagacacaaaaggcttgcatgccagaccttctcatgatagacgacagtgattgggaatggtgaaagtggattctaggatgaaaatgtggatccacaaggatgaactgggattgaacacaaggacctgtgcttgggtctaacaagaagcgacacatgccagggtagggggggatgtggcttagcaacagcagaccaaccaagaattcagggtttcttagtggcccgacacttagcagcgggacagagctgcccagggttcgtacggcctccatggtgtgcacaggtggcagcgcagagagaacccgggcaggtggagctgggctgaatgtccacgttctgcctgtggacagggcctcgggtgagagacttcacaatgctgagcagacaggctcggaaagggggttggggaccgacagatgaggcctggagcagatctcacactggctgaccacaggggtcaagcagcagcaagagagcagaataccgagacctggacacgcacagagccaggaggaaggagggccctgcccctgtccagctctcagagatggccaggcccttcctgagcctggctgcacccatgaccttgggctctaggagacccccccccagggtcctcccaataaaactcccttttgtgctcagccggcttgttctttgcagcgagcgtgtcctgacccacgcaaatgtggggaactggggagacatttcgagcacagggagggggaatcaaggaagatgaagaaatgagctcactgtccagcctttatgtcagtctatccaaggcaggaaaggccacttcagaagagactctctaacaagggaccagcagggcaggctggctgactggtatcagaccaccttcagggcatctcctgacctgagctggggcgaattgccttaaccggtcacctgcagatgtgaagatgttcagtgtctgggcatcctctcctcctccccacaacccaggctgcagggtggcccgtgagccctcgtgggactggctccaccacccctcctccccagctggagtcaggcatcttgcccctgcctctgtggttgagtgcaggctgggactcgtccacctagaacgggccccaggcctccagatggtgagcgtttatgggatcccgaggctcccctcccccacacccttattttccagatggggaaaatgaaggccagaaacaccctgttggaagttacgctgcggatttgtggcagggccagtatgagccctgtcactaaccccttcacccgctgtcccacccacctgtgactgtcctcagacagaggctgccccgggggagagggctcccaccacctctcctatctgaaagcaacccccaaggctggctgcgccaaactttttttttttttttttttttttttaaagacaaagtctcactctgtcgtccaggctggagtgcagtgacgcgatcttggctcattgcaagctccgccttccgggttcaagcgattctcctgtcagcctcccgagtagctgggattacaggcacccaccaccacgcctggctaatttttgtacttttagtaaaaacagggtttcaccatgttggccaggctggtctcgaaatcctggcctcaagtgatccgccgcctcaaccccccaaagggctgggattacaggtgtgagccactgtgcccagccctcaatgtgcgaagcttaaccccatcttgcctctcctcactggctgctgcccaaggccaccctcttggtgtttgtctgtcctgagctgctatcacaaacatgaaatggggggacactttctgtagcctccccatacatgcccctctgggaactttcctgtcccagttcccagagatctgagacacattttctgccacacagaggaaggcttccaccgtgcccaccccacagggctgcagcatgcgtcctgcctgcctgtggacacagagctttgctgtcaccccaggaagccccctccccactgccatttccctggctctgagctgcaggatgacacccaacagacttccaggaagagacctcggagctgctggagcacaggcaacgtggctgcttggtgtcctcagcagggcgcccgagcccagctcggattggtgtgcatggcctcagccccgccacgctgccgcaggaaggagccccacgaatggttacgacatgaatgacatgtgctgacagcagccacggcaaggagggcaggactgaccaaccccagccgaaaatgacagctccggtcagggccactgtgcccttcccaggaaaatgggcagcttggggtaccccgtggcccctggctttgtcctcagtccaggccaggatcccataaagatatagctggggggtcgaggttcttcctcctaggaaagctgctcaggagccccaaggcacaaggaggggcccttgccacgtgtgccgtgggcagccaggcccattccaggctggggagagggagacagggtaaagagagtcaggccactctgttcagcagttcagtttttgcaaagcaactgtgaccgaaaaccaactgcaagattctcaagagccctgaagagtcaaggaaataaatcatccaagaacacactaagcccgccaagggcccaccctgaccatgtgggcagagatagcttgtaaggctcacagttatgtcccccaggtcatcaagggccagaggctggatgtgggtgctccgagattacagctgaatcctcccctccatacccgtgtccttcagggactccccaacagcagtggcaatggccagagagccaggttctgcctgcacggttcaggccatggctcatggcagcattacaatgcctgttgagcttcccaaagcagaaaggtccactgcccaccccggggagcagtgagcgggtccctgtgggtcgcactgcgcacacgcctctgttccagcccctgctgctgcccaacagcacaatcctctcttctcatgtccatttccccaattagactgggagctccctgtggccgtgacagtgtccacacacacgtctctggctgcccacagctctgctctgcagagggctgggtaaatggtgagcgctcgtaaaacgttgaaatgaacagcagtgataacttggcctcgggttccatcagacacatcagcgatctctcctccagactaaaactgagcgtgctgagaacaaaaactgcatcttgcttgactggcttctggtaccccctggcacacagcaggggtctgtgccattttgttaaatggatgaatcaaacaaacaggattaccatgtcaggctctgaggcaagatgggcaactgttctcagcttcaccaggattcccaagcaccagaaccacctctcccaactcccagggcctaccccacccacagtttcaacagaccccatcagacacggacaccaggcagtgccacttggagggaagccccggtgaggccacagggacacagaggctcttgcagctgaatgcacagagcccggaggcaccccctcggggcacggcaccatcctctctgtcagtcttagcaaatgctgactactgactaaggacctattaggtcgcagtccctggagattcggagagctcaagcagtaattttgagcctcctcaatgctgctgccttctcccatatatttccccaggaaccccatttttaaaaagatttgtttctaccaagcaagctgtgtttattaagcaatcatttaatttcctattttcctttcatagaaaaaaatccctatgtaccaatcataggcttctgaccagcatgggctcacaaccctgtgaccatcaactgtgcaggaccccagcccaaggcaaagcaacctgacatttcccttcatccgcgtgaccgtctaaaggagaaacgtaggacccccccacccgaggatgactacattcatcctaagagaatcaggcctgccacagaagactgctggaggaaacacctcagtacaccacccctgtactgggagaggaaagagatgaagccccagtgacattcaccttgcccaaggccgtgagtgctaagaggcaaggcccgggcaggtctgggcaggaagtaaaagcagaagaggactcctgttctgctgtcccttgtcccaagtgcacaacagaggcgaagggtggcatccctcaccacctccctccctcaccacctccctccctcaccaccgccctcggagtcctctgctcggggctctccatccagcccagtcccccagcccctggactccccacgccaccctcccagacagaggcccacctgctgccgctcccccggggtcagtgtgggcgagaggccggctggcctgctggcgtccaggctgttcttggtcagtgcgaggggctgctccaggccaaggctggggagggaggtgtacaggtggctgccgtgcaggctcatggtgggggccacagcgcgctcgatggggctgcggctccgctcccgggggtctctgcggcagtctccattggcagtcttgttcctgaaaaagaggaatgggcattcagggggcgttttctcaaaggcaaaggggacagtgactgtgcgccaggcactccgtgttgcttatttaattttttaccctgaagctcaggtcgtgtggctgggcagcacgatgaggagccggttgccagcccgggtcagccggacaccaaagcctctgggtgccggagaagctgctgccagcggagtccaaagtcagctccatagaagatggagcccccgactcagtggcgtcctctgcctgactctgtgttcacttctataataatctccactccctgggagcctggggagctggaggccaagctggttcgataaggacctgccatttggacaggacggggacgctgacaacgatccagagtcactggctgcgtcctacatgcagggccctattcaaagcctccacagcactgctcagcccatcttcctcacagtactgctcagcccgtcttcctaacagcactaagcaggcaatgctgccaccatcccctttccagaccagaaccccaagactcaagagtggtggaataatcagctcagactcccagctgacatgtggtggcacgtgctctggggttcccggggtgctgtagggagccggcgcgcagctctctcgtccaggacacacgagcaggagtgacctgcgtccagaaggtccatcactagccctggccatgtgctgagcacccaggcgatgccacgtggaatccaggtgagacagtcagcaccacctccatctgatgtgttagtctgaaggcagcgttacgtgttgcatctattagacaccaaccccacacaggtaagccatggccagccctggtccaccctccctgctttattccaggggtcccacagttccatctgccttgggtcttgccccttcaatccaccatattatccgctgacagagtaacctttttccgtaactcatgagctggtcatttaaagaaaaaggtggtgaattatgatttgagtgaattttaagaaatacaaattattttcagagtctacaagtagtcacctgtcttaactagcagaaaagcctaggcctgccctggtgaagcagcagccacagcccccgtcccggactggctgaatatgttacacacacaatgaatgttacacacacaatgttacgcatgcacacagaatgttacacacacactgaatgttacacacacgcacaccacacacacacacgcatgtgataggcgtacctttctaaaactgtagattaacttcagttgtaagaaacaacacacggccatcccatgcaccctttaccttgactcccgcgatggtgacatcttgtaaaactacagtacaatatcacaaccaggatatcgacaatgagacaactaccaaccttattcagatttcgtgttttgcttgtatccattccagagcaatctctttataaggcaaatccaaccacatccagcccttagtgaatgtttttagcagctcagcacgggccttggtagcctctgggcctgaccaccttcccgtcctcatctctggcttcacgcctccaaatgttgtgttccgtagttccaaccatctacttgccattcctcaaataagatgcggccactctctgcctctgtggctgtgtacacgcggtgccgctctagcctccctcctccccgtcctgcgctgccaaccacagctgcagtgtagaatcccaaggcgccccgtgcaaacctttaatacagaatccatcccccaccgtcaatgatctcttcgtctacgcacccgcccctcctcacacacggcagcctctgagggcgtcgagtccctcctgtctcattacgcttgctaccaggggtgcacagagacttaacgggtgaatgaagagaagcagcatatgggtgaccgtgtaagaaaggcaggtatcgtggagtggaactgtgggtgggcagaatcatggagagctggagggctgaggagtcaactggaggcgcattcaagcctttagatggaccctgcggcccagtcggtgagctgctaagggctgagcaggagaagcaccagagggggcctgagtgcagcctcggctgtgatgttgtgatgtcattctgcgccatctccagcaggggcacgcgctcagcttagtgacccgaggcgttccgagcctcggcgtccccatgtaaccatgtggtcacagtaagatccacccagaggactctaaatgggggacaaacagcacacaaacaaaaacaatcagagcggcgcagtgcagccctcagtgagcgccaagagaaccctgtcagccctaaaccgagtatattgattatagggtgattagctgtacaggacccagtattcgtttatggggtttttttcttcccctttattttctggctgatgatacagaatatcttaaaagcaattaaggattaaatgttcagcccattaagacaatcatggaagagaatgttctggcagagtctagatagtaggttccatccacgccacacacatcctggcgattttcaaaacgttaaaatactaaaaaccttaatactgaaaccagcctgtccataatgtcatctgtctgtggcgattcagaagacagcacaggtttctgcaatgaatgcctcaagggttatgatcccagacaccgatgtcaccagaagaccttccgcggaacggacgtcaggccaagcagtcctgagatctgctggcttctacctaaacgggacttggttcctgaatactcagttcatcagtgtcaccacacatcctcatcttcagtgtcccgctcccttctaaattcagataaagatacaattttattgttaacaacatgagtgaatggcttctctccaccccaggtgatgcttccacgggccacttcatgaagtgcatagacctgggggctcatgtcccagattcaggagagcctcagacacagtctgcctccgaatttagacgtctgtttactcaaccagcgctagttaagtccctgttctgtggaggttccagaactgcagggttacagccctgccttctcatgggcttacaatctagcagggacagaaaggcccgggaggggctgcagctcccaagtgacagctctggatccgggcaaggataaagacacccccgggtggcatggaggagcagactaaaggtcaggcgtctgcccatgtccaaagccaaagtcgtggtacataaggcactgcccacccctcgcaccttatgtcctaggggcacggcacagtcacgcagatgactcagctgcgccttaggaaatccaagcatgactatgagaccacatcacagaggaaaggggtgccagggccgccagctgccagggcagaggtaaggacggggcagccctgcacctaaatctgccatctatgctcccacagccccactgtgcgcccaccctacgcagggcagcagggagaaggggacttccaggcccactaactggaaagacagtccgtggaacacagcacagtgggcactatgggtcagacaaagacactgaaaacagcgagaaaaggcctggagaactggctggttaattttagtaaaattatacattactcacatttccagctcattttcctggttcccggagcttcaagacagacattgttttccaggccccgctcgcccggatgaatcacctcccggccactgcttcccaggcgtcatgtgctcccggggacggcagaaaaccgcacgcatcctgcccgggagatggaagtcgcctccgctcctggtcaggactgtgcccgagagagcccacggcatccccgcgaacacccaaaggactctgagtggctccgtgccaggcctatcagagccgctgaggctgcacggcacccggccccgccccgggcctcatccccatcctaggcgggcacttccactgccagctgcccacggagagaaagatggaaagaggagggagggaaagagaggcctacaacaccatcatccaggacagagctttctgagtactgaaagccacacgctctctaagctaagaaaccaagaatgtccataacatctggggaaaagtaaaccagattccaagcagtgacattgaaagaatccatcacgtgaaagaagtgcactgcgtctatttgatactcattaaaatgagtttcccaccctccaacaaacgtgctttgggatgcttagcccttagccccatcacctgacgttctgagcctgcgctgggcttcattcaccgtggactgccacaagctacactgatctgagtctgagttcctctgcctggggagggggtatgggtacaagacattttgaggatacattctggggtccccaaaggcccctgagcaccatggcatggcaggtgctcccacccagtgaaagagatgaggcccagggcagccttgggccctggcctcccaaaaaccaacatcctgaggcggcaaagcagcccgtccccatgccaggcgttgcctggcaggagtagaatgaaggctatgcagagacatcccccaagcaccagagtccaggtggagacaagagattcaaaggaggaggggccggcacagggccagtgagtgggccgggacacagccccatctccagccctttcgtcctctctctcccaccgcagcagttacaggagaatccgacatctgagaactggcaggacagccagtcgttcacacagtcttaacacatcataatgagactgctggctgggcatggtgacgtgcacctgtggtcccagctacttggaggctgaagtgggaggatcacctgggcccaggaggtggaggctacagtgagccatggtcacgccactgcactttagcctgggtgacagagcaagaccctgtctttaaataaataagattgctagcacatctttaatcttaaaaagcttcctcagaaaacagacttaatgccactgaagggtgccctgaaacctggttaaagtggtcagctgtatgctctgctaatttactacagctttttaaataataaaattttacctgaataatatagacagaacttcctcccaacctttacctgctgccccctggggtttctgatgtgcacagggcaggtcagcaccatcccagttttacagaagagatgaccaaggtggagaagatgaaggctttgcctagacatgctgcccaccacagacaccggccctgtggcatcagccgctcagggtcgtcacaccaggcccaccaagagactctccatcacctcgcagctccatcccaagctgccaggaggcctttccgacccaccagcaccatttccacccaccttcctgccccaactgcagagacacaggaaaggagcagtgcggagatgccggccaccaaggtctgtccccggacagtcctgccacgctggctttctcagtcagtaagcttctgaagcacagctcccaggggaccccggtccctggctggaccgtgcactcccgggaaggctgacactgcagcccccacgccctaatctccttggctccgcacgggtgaccacataccagatgttctaataactgtccatagagtaaataaatcattaaggtacacatagtatgtgtgagtccagttaacagcgtttgtggcaaatgacaagggagttaaggagatttcagagaaaatgactggtggcaaagacttttttctgaaaaagcaaaatttaaggaacatttaaatgttgggcataaacagtggtgagatgtcttctcccttttagtcccttcctccaacttctgttgtcctcctcacctcctccctgcttctaaatgtccccgagctcatccaaagcaccccacaacacacacacaggagtgaactcatcaccgtggcttctctccccttgtgagtgggagaattcactgcttcccagtgagcaacaaggtgcctgggtgtgtccccaagacatcctggtcaagctgcgtcactcctctgtgccaattttagacgggaagtgagggaagtggttgcaaaggaaggcctgggtgaagacgatgtttgccgaggtggcggaggctgaggcagagacaccctcctaagtacaaatggcaagaagtgtgtcgtgggcaggaaaaagctggcaaaataccggcattcggactgtcccaaagacagagatgaccctgaggctcctggcttcaatagcggggtccatcctcgctggcagggacacagggcagagactgtctctgccttctatgcgtcagcaactactgccatagcttaacattgcttaataattgaaaaaaagccaccaaaaagtcaagggaatgaaacccgagtgcgaatgccgccacagccagcatcactgccacaaccatccacccacgtaatgtttcccccattaactctccataaaggggccaggtgcagtgactcacgcctgtaatcccagcactttgggaggccaacgtaggtggactgcttaggcccaggagttcgagaccagcctgggcaacatggcaaaaccccgtctctacaaaaaatacaaaaattagctgggcatggtagcgcctgtaatcccagctactcaggaggatggctggagcccagtaagttaaggctacagtgagccatgacagagccactgcactccagcctgggcaacagggtaagaccctgtctcaggaaataaaaataaaatactccccacaaaggtagtgtccctctttttgctggttcagatttcagaaatcaactccatggacccggcaacacaggactcatttgctccatctattgcgagacagctgtggcttgcggtcccagcgtgagaagcctattggccgggcacagtggctcacacctgtaatctcatcactttgggaggccgaggccggcagatggctttagcctaggaattcaagaccagcctgggaaacatggcaaaaccctgtctctactaaaaatacaaaaattatctgggcgtggtgtcacgtacctgcagccccagctactctggaggctgaggtgggaggatcacctgagcccaggagatggaggttgcagtgagctgagatctgcaccactgtattccagcctgagtgacagagtgagaccctgtctcaaaaaaaaagttggggaatctctgagtaagtgattgacgttgagtatctttattatcatcagctctcatttattgaaggacatgcccaatcatatgctagacctcatcttagtaaattcactgccccactgcaaaataagcatcatctccattttacaaataagtaaactgagcttgagagaggctaagtaacttttctaagtttacaaaactagtacaacgattccaatatatattggactggctccaaagcctttccattttccgggagggaggaaaatacaaagactcgtgtacctaccactcagaactagcaaatgaaaatgtgctctcatatttgcttcgggccttttctttcctctggccatgatgaaagcagcagaacatgcagacgcatgaggtccctgctccaggccctcctcagtcccattcccctctcttcgtcccctggggcatcctctgttttgtatttggtgcctcctgctacctgactgtcgtcctcttgccacacgtggatgtgtccggaagcacacatccgtcgcatgcttcacactccagcatgccagcacactgtatgtcttgttgtacaaccgtgtctttccctcatgttggtcttggagctctacccatgttccaacacagagacctggcttatccatgttatttgcctgctctgtggtattcttccatacgaatacaccactgcatatgtacccgttcctttatggaccggcgcctgggcactctttggtttttccttctgaaaatgacccccgtaggccaggcgcagtggctcacacctgtaattccagcactttgggaggccgagacaggtggatcacctgaggtcaggagtttgagaccggcctgaccaacatggcgaatccccctctactaaaaatacaaaaattagctgggcttggtggtgggcgcctgtaatcccagctactccagaggctgagggaggagaatcggctgaacccgggaggcggaggttgcagtgagccaagatcgagccattgcactccaacctgggtgacagggcaagactccgtctcaagaaagaaagacagacagacagacagaaagaaagaaaagaagagagagagagaaagacagacagaaagaaaagaaatagagaaagaaagaaagaaagaaagaaagaaagaaagaaagaaagaaagaaagaaagaaagaaaggaaggaaggaagaaagaaagaaagaaagaaagaaagaaagaaagaaagaaagaaagaaagaaagaaagaaagaaagaaagaaagaaagaaaatggccccatagtgcttaagtcctcagacatgtgtcctggtgctggggacagggcttctgacattctctcaggtcagtatttgcaggtcatccaccttcgacttcaacacatgtgaccagaaaccttcccaaggcagccatccactttgctgtccctccgacggccatggctgaccactgctgctgctgtgtatcctcggtgacatctggccttggcagcctatggatttctgccattctcctggcatgaaatcactccttcttgttgttttaatttgcatttcttcagttaccagcgcagttgagcatcttttcatacacttactgaccattctactttatgctgtgaactgcctttaatttctgtaatgggttgaactgtgtccccctgaaaagacattgaagtcctaaccccctaggttctctgaatgtgagcttatctgaaatagggtctttaccgaagaccaagtaagctgtggttatgagggcgtgctctaatccaatgtgactggtgtcctattagaaaacactggaaatctggatacagtgacagacacatacggagggaagaagatgtgaagacagagagaagaccgtcatcaacaagccatggaatgccagaggccaccagcagctgagagaaaggcctgcacagacgctccccacagccctcagaagcagccagccctgctgacaccttgatctcaggcaccaggaacggtgagacaatacgtttttcttaccctaagccaccccatctgtggccctgtgttatggcagccctaggaaacgaacacaattccctaggccgtacccacccgctgccttgctttacacggctttagatatttgccacacccatgtttcttctgctttatctatgatcaacctaaaagtttttaaagcttcctctggacatttaaagagaggtcctgagatccactgggcctcggtcacctgtcctgtatgcctgtcatcctgaggcactgcacgagcaccgcacaatgacagtccaaacagagaccagagctgggcaggccaagtcagcccagacctgccagtaagaagctgagagttccagaggctgggaagggtagggagaaggtaggggctggagagatttgctaaaggatacaaaattacagccaggtaggaagagtaagttccagcactatggtcacctagaccactgtagggtgactgcagttaacaataatacactacacagtttcaaacaacatccatatattggatgttcccagcacaaagaaacgattaatgtttgatggaggctaaccaccctgagctcatcactctacatgacacatgtcgaaacttcactatgtaccccatgaatatgtacaattactgtcaattcaactatatatgtgtgtgtgtgtgtgtgtgtgtgtgtgtgtgtgtgtgtgtgtgtgtgtgtgtattttaaaagctggagggctagctgcccccaaatatggttcaggaagccaggaaaaagagccccatcttatgcgcctacatacaaaagggaagaagcttgtcggccgagttaccatccaaaacccttttggcttggtagtgtttggggaggatgaaagaataaagccgcagatcttttcattactcctgcatctcctcctctctcttcttcaacgctcgtgccaaccccccattcccactttacaccgaggaaaagtggattgagaggtggagggatctgcctggggccatgtggctggcaggtggcagagtagggacttgggtccttgctcccctgctgccaatgcccggagggtttcaaaagcagctcaggtctgtggtgcgagagggaaggcggccgcactgagtgctgtcagagcaaacgggcgtccattctgctgctctcctgtcagtgtggactctgtctctctaactgcgccaagggtttccagtcactgtgctctcaagagtgacagtcattaaatcagcatagccagcatctccacatgctccagccttcgagtttcttttgactccctccagcagctcagctggaatgtgcatcgtgtgtgagtctgcccctctctctccttgagactggaaggagctccgagggcaaagtgggtccctcctttccttgggcacaatcggtcctcagatctgtgcaagggacggaagacacttgggaaacctggcggatccggaaccacagtgtgcacttacccagcggcagccgcttaaagaaagatcccagacaccagccttaggagagaaactctaagtgattttagttagagacctgtcggaaacgctgctgctggaagtctccatctttccattctccctatggtggcccaaaaagccaggtggctggtttggctagaatgaggcgtaaagtcagagcaaacaggttctgagtgagtctggggccaacccctgcaactttcccatatccaattccagcattcagagaccctctttgcttggcaatgtgtgcaggctttccagacccgttgcctctagagaggcgggactcacggaaatgctggccagcagcgcggagcccgtccaggttgcccagatcctcaggtcacgtttctgaatagctcaactctatgtaaataaggtaccagttttctttaaccagaactgtctacatgtgttttccattattagctttagttttttaagaaaaactgatgtttgagaaacaggtcatggctgagaacatgaccggtaaagcatctcacctgcccccacgttagcaactgttgccagggaagtagttgtgagagcacagccagcagtggatgcccacctgcggccatgacccccagaacttaattcagatggggcaggaatccatgtgcatgctaagcactgtttacaggcaaaacagatgtgtcccacattagagttttcaaatgaatggagatgttgctgagattaataaaattgaaaagaatttaaaattcctactgctaatttgtagttgtttttgtcattatgtaatctctcaaggaatatgttaaaaatacaaccactatcatatttttgacattaaatagagtccttgtatcacagaagggatgaaaaacactctatctttccttcctcactgagctgcagtgtctgaggtggacaaaaccctgggagacacggcgatctctgcacagcagcagaggcatcagcatgtcggcatcctgccttgccatcctccggggactacttgagacagctgaggcgaggactagagggaggggtgaagaaaaggcatttgaccactaagaccatccagtgctagtcaacccagacgtcctgttctccctgctgcttcactccaccccacaccctcaatctgactctgagctccgctggaaaggcctttcctgtgctggaaaagtggagggcaggacccactgcctccgatgcccgcctcaggaaggcagagggtggagagagagcccatccaccaactcaagactaggagagaagacacattccctctagacacccctggagggaaacgggaacagtgtctgctcggtaggctgctcagaagtgtctgcaagtcactgtctagaacagggcctggcacacaactattttatgaatgagccaaccgaaaactaaacaaattctcaggagaaaccagcagcaacaggttagagtcagacagaggagctcatgaagctgggtgacccagggctgggccatccatggccctggggctcctggggaaacccaaggagaacagccctggccagcgccaaccccctagaaacgagtggtctgaggagaccttctgccattccctctctcgttcttgcgactggcactgtcatctttcaaaatttcaaattcttttgaaggctcactcttagtttttactccatattatgcagcaaattgctggaaaatattataaaactgtttagtggccaggtgtggtggctcacgcctgtaatctcaactttgggaggctgaggcgggcagatcacttgaggccaggagttcaagaccagcctggcatggtgaaaccccgtctttacaaaaaatacaaaaattagccaagtgtggtggtgcatgcctgtagtcccagctactcgggaggctgaggcaagagaatcgctggaacgtgggaggcagaggctgcagtgagccgagatcatgccactgcactccagtctgaacaacagagcaagaccccaccccccaaaaaaactgtacactggaaagattggatgctttgtccaactcaggagaacacttcacactaaaatggttttaacaggagagagatgtggaatcccagcctccctcaaggagcaccacacagctgctgcttaaacactatccagacagctgcctacctccttcctaaaggttctccctcctaatgaatgaactctgccttcaaatacaattctttggtcccaggtctgccctttggaaaaattcaatgaatcttatttcctcgtccaactactgaaaaggacttctatgtcaaccttgccatgcccagaattctccttcaaattactctgacacaagactccttatccaacctgtcacccacagggcacatgccacaagtgaacattcatatttaagagggtcacactccagaagcagcctaaggaaatagggcacacaggcaaggactcactcccttccatttatcgtagcacgtttctgaacgaaacaccagcgtagacagtctaataaaaactaacctaaagcatcaggattattccaagacctgcagtcaccagtactatcctttcatcaaaacaacccaagatgccagtaggcacttccacacccatgttgcacagtgtggtcacataaaagtctccaatccttttcttcccattatttcagctttgtgaccccatactggctaaagaccagacatgaatgagtgcgtgcaggcatatgagagacaaataatcagacttcctttctgcgtcacgtggtgtgtggcagtctcctcctccccacacaccggagcatggtcacaactgcctgaatgccagccgccttcccatggtccagccctaaggttggtaggaaccagttcgaaattattttgtggacttctccgtactacaggaagacctctggttcaataaatttattcagcactaaataaaaatatcaaacctgattttcctcttaaagttaccgatctaccctgactgaactcagaaactctgcaaaaaaaaaaaaagtaataataataaataaataaaccccaaaactattgagctaaattattatacacccattgaaaatttgagtattgagtatacgaagtgattaaatgctcatctagtaagagattttgaggcatctactgtatattttctttttttttttttttttttgagatggagtctcgctctgtcacccaggctggagtgcagtggcgtgatctctgctcatcgcaagctccacctcccaggttcacgccattctcctgcctcagcctcccaagtagctgggactacaagcgcccgccaccacgcccggctaatttttgtatttttagtagagacggggtttcatcgtgttagccaggatggtctcaatttcctgacctcatgatccgcccgcctcagcctcccaaagtgctgggattacaggcgtgagccactgcacctggcctctactgtatattctttaaagtactaatagaccgtaaggaccttcctcctgagagccaatcatgtagtgtgttaattctcaacatgaactgcctctgagcatccaggtagtcagggctacgctccatctttccaaaactagggggaaagggttggccaagctaactttctaaaaaaaaaaaaaaaaaccagactgctttacagaaacaagatttacattacttaaagaaaaaattattttgaggacctccaggtacttagcaaggctactgctttactgacaatggacaccctaatgacaaataaagcagagttcccacgggaaaaaaacagtactgagagcctatttcattgatctgagttataaaactgcatttcttttaaaatagtctcattttcaaattctgcaaaaacttcagaactaagctatctctggagcttcactgtaacatcactcacatctagatgcaaccccctggctataaaatcatatttcacccagaagtgttcgtctgtggagtgtgcagtgtggaagactgaaaagaacgtggggggagttcaatcattccattcaacactgaagtggcatctcttcccccaaactcgtgagttgatgattcaaataatgcctccagagaattcagaagcaccctcccccccaagtttcatgcaccccaagtttcatgcacctttcctttgtacgagggcttccaaaccagatggtaatggtgactcttcactactctttgaattaaattaaaattaccacccccggtggtcatcacgcatcacatctgtcgattattaggcaccaaatactgtattcctggagctcggtctgccctccaagctgcctgactctccttcacagcctcagtcaccccagatgagtatggaatataaaggattcacacacaatggactcattaatgtttattcagttgacctgaagttggtcatcacagtttttcatattttttttactatggtaaagtactacatacataaaattcaccacttttcagtgacaataagtacactggtatgttgtgccgccaaccgcaccatccgtctccagaactttttcctcttcccaaactctgcactcattaaacaccaacctcccatttcctccttcttgcagccgctggaactaccattctaccttctaggactttcactactctaggaacctcatgtcagtggaatcatacaacatttgtctttccatgactggcttacacaaggtgcatctgtgtggtagcatgggtccgaatctccttcctttttaaggctgagtaatattccattgtgtgtacagaccacatttggtttttccattcatccggtgatgagcacttgggttgtttccaacttttggctattgtgaataatgctgctatgaacatgggtgtgcaagtatccgttcaagtctctgctttcagttatttcgtgtgtatacctataagcagaattgctgcatcatatgataattctgtttaatgttcaacacatcattggtagtaaaggaggtgggaagtataggatgcatttttcatttaacgtttggccctctctactagagaaaaattaaaggtttccaaaaggatggatcttgtccacaacaataactgaaattgtaagcctttgtgaaaacagcccaagtggttcatgagagaaatgaatgttcatcaataatgtaaacactggacataaaagttaaatcaacaaagaatattcaccacccagctcactaaatccagcaaacttgggcacacaaggggcccactggagtcaatgatgttgtaatcaacagtgagcatttcggagacttataagctacatatttgtggttctcatttctcactgtgaacctttaaaaattgtttcaagtcatcggaggatggctaatgttaacagcaatacatattgaccatttgtataacattggtgtacagtgttacaaagtgctttgcatatacattatgttaacagatcctcttcaatctgcaactcctttttttttttttttaaaaaaaaagataactctttctctgtcgccctggctggcatgcagtggcacgatctcagctcactgcaacctctgcctcctgggttcaagtgattctcctgcctcagcctcccaagtagttaggattacaggcatgcaccaccacgcctagctaatttttatatttttagtagagacggggtttcaccatgttgatcaggctggcctcaaactcctgacctcaggtgatctgcctgcctcggcctcctgaagttctgagattacagacgtgagccaccgtgcccagccatgcaacttctctttaatggccagaaagtgcatttctcgaatgatgaaactaaaacccggagggtcctcatctgtgcaggcaggtgagcatacctagacacccggccctcaagcagtcacttactccactctccattttcaacccagcttcattcggaacaaggaggggacaaaagggtgggaggagaggctgctctgtggaatgaccgtacaagttactgagagatgaaacaaaagcattcattttctattaaatgtgaaagatctctcaatctctaattggtcctgcactctaaggcaacttagcagggactcaagtacaatttccatggagagaagtggtcaaatagctgaggtcaaaccctccagactccaactgcagccaagtgcttttatttcccttgtaattttctttaagaataaatgttaaacctaaaacatacccccttttggaggcgatcttggcagctggactgagtgggaagaaaaagcaccttgtactccccgaatcagcagccaaactatgcaccattgtctagaggcggtcacatgacagccatcacctgaaacttggttacttccaatccatgaaggaaacaatcactagtgtgccttaacccttccagctactgcaggcagccatgctgcagctgctctcagcagccctctctcccattccagtccccgcttaggagaaactgtgcatggcacaaatctgattgggacaaggtggcgtttggggagaagggagggacgagaaggaaaatcactgctgtcccttctaagcaaagactactctacctctcccagcacttgctgtctcgcagtttaaattaattacagctgaaaatacagggttgccatctggtttgaaaaagcaaggataagggaataaaatgaaagggttcttggtactaacctcactttaatcattgccaaagagcatgaagacagcccagcgtcctcccacaagaaagccttgggcctcacaaacttggcaagcagtctcaggcacaaaactggatgggcgggcgcttgtcagaataaaagtcctccctgaaaggagggttgcgaggtaaggggcctgcttgccccctgcactgcaataaaagtttcctatgggtcctggggtaggtcaggaactcctgggagggtttatttatagagggtgccttgccaaaacgctacacgcatcattacagttccatttggtgagaaaatagatttgctgtcagaattacagcacgcgatttcctctttctttgtttctccatcttccataacataaggcttttataaaacttcaaaataaggctaaagaaaacacaggagaggaaggttgctgcagaagtggagacgctccgaaggcacgatgcatgcaactccacagcagggctgcagccggcccctcagagaaggaatgccagaaatcccctattctctgctgcagccgcaactacagtctcactcctgcactgtaggaagcaacttccttctgcctcccttccaccagcagaaccctaggtgagaggcttttctcttaggactcaggctgccacagatggtgactccaggcactggagaagcaaaggtgccacagccatcctaggtttgtcttggtgaacttacaggtgggtgcaagaagttgctaagtctgcagatgtcttagccatacgccagcatcaagtagcccggagaagtgaagcagaagattttcagcccaatttaaatttccacctgcccactacctgagttcttttacacccaggtcagttttgcaaacaagaccctgatatacccaagcccagctgctttcagaaagtaacaccaattgaagcaccacggtatttatcagagtaaactctgatcaaccagatatagtattttataaaccagaggttctaattataaaagacaagataaaagcagattatgaaaatagcatttctgttctggtgaaaaacacatcttcaaccccaaaatgatgtgaaaattgtcttccaaatcctgccctgacagaatcactgtctatagcaacagtgtccataacattccaaatctcaggagtgtaactttctagtaaatggtacatctgtcaagccacaggaaacatctggtaaaatggttaaataaaagcagaatttaaacttttctgatttcagagcttactaatggtactcaacaagagactatcaaatactctaaaagctcaatgtgacagtgaaaaatatcctggaggggaccaggtgagaaaaagaggacaaaaaaagaagacaacccgggaaggagtgggctgcaatcccactctcgtcacgatgacgatgctcccattccaggcctgcctctgggagacagtggccatagccccctcagctccgccaaggatgggcacattcctgcccatcaccatggcagaaaccttctctggcctagttaagttcctctctacccagggctgactcccccaagcatactcatatctccccaacgcacccaacccaggaggccctcaggagaggtttggggggatggactgacgaagtgatgacacacaaacaataagcttccctccgctccacggcagacatgtgtattaaacacatacaatcattctaccatcaagacacacccaggccaggtgttacacaatacatttcagtcccttccagaacattttacgaggcttttccattaaataaaagatttaatgatttggccacatccaaattttaaaaatctatatttcaaaaatacagtaaataatgctgaaaagcaaataacattacttattttccccaacgcatttgacagagcatccttaatatgaagagtcgtaacatatcaagagaaagaagatgaatactctaatttacaaaaaagacaaggtataaacaacatcatggtcacagaagaagaaatgcaaacggccaataaggatatgaaaacatcattcaagttctctagtagcagaaaacaaacaaacaaacaaaaaaacacacaataacaatgtttctccccgagaaacttgcaaatattatataaatgaataaatggtagcagtcacctgtgggaagatgccgagagagagacagatgcatacagctgctggtgggaacagatcagtaaaccatatagagtgaagctggcagaacacaccagcgaaaacagacatggaagacctctgacccagaaattccacttctataaaagtgggaatatatgagatgggaggaaggatggagatattcgaagttctgcaaatgacagtaaaacaatgtaaacaacccaaatatctgtatttgttaaaaagttcttttggttacaagcaacataaaacaaacctagtttaaggaaaaaggggcaacttactggaaagatactgtgatatttcttggaaatgaaaaaatgctgaccaaccaatccttgaaaagagaaaaaaaaaaaaaatgaggtggccccagggatctgggcttcaggaggcggaaggcgcccatggtgggtccatgtgcagcatctcaccagagcctgccttctgccctctcccagcacccagggatccaccaccaccaccaccaccaccaccggctccaagtgtcacaacttggtgaccttcctaggtcctatgtacatatcatcctccaatcactgctccattaaggagttattaacatcaagtcaaaatcccaagaacactttttattatacatcaaatatgctgctaaaaactagaacatgccccaacacacacttaaatgctaccagttttcacagtcaagagacttcactgggctggacacagtggctcatgcctgttatcctagcactttgggaggccgaggcgggcagatcacttgaggtcaggagttcgacaccaccctggccaacatggtgaaacccagtctctattaaaaatacaaaaattagcctcatgtggtggcgcatgcctgtagtcccagctacttaggaggctgaggcagaactgcttgaacctaggaggcagaggttgcagtgcaccgagattgcgccactgcactccagcctgggtggcagattgagattccatcttaaaaaaaaaaaaaagagagagagagagggagagagacttcaatggagccttgaatgaattatttataagtaaaaaattgagggatctcccaagagagaaatctattatggtcttgtttcagatttgtaggtttaaggagaaaaagggacaggggaatgttccacctctgccatgaataagatactggattttttaaaaaagtaaaactgctggaattgttggctagacagagatgagcctttggggcaggaaatcaaatattatgaaaaggtgatttatcttagagcaggcatgaggtgtttaatttattccatgtatctcgccatcttgcattccaaatcttctgcctcctccaacagctctcttgcttcccttgtcctctttctgaatgcacacttcccaccacagaggaaccacacatatcctaaatccctcctttatcatatacaacgtcacccctcccagtgctgatggacaggcgaccccctgccgttggtccctgggtgtttcaaagagaggccctgaggagctgacactccagagcagtctctgggtcccctcttcccatgaaagcccccaacccttccccctgcaaagtgggacaactcctagattaaagattgctagaaaatacaatgactaagtgtagtgtgattcattactgaatcttgaattaaaaagaatgtaaaagaattttttaaaaaatcttaaagtataaagggcattactgaatatgaaaagatgatgtgagatcatatcattgtctgcacacatatgaaagaaagataaagcaaatacgggcaaatgttaacaaccgatgaatgcagggaagggtatgtgagtgttcactgtgctagtccttcagcatttctgtaggtctgaactttctccaaaataaaaagtatctatggtgaggaaacggtgcaggaaggatagaaagaggagattatcaccaaatttggctggaatatgtagaatgatgtgatttaaagcacaggtaatatggtatacactgccctccatatcctcaagttctgcatccacagattcaaccgatcatggatggaaaatggagtcaggcctctgatggtacagacttttttcttgcttaggaataataattccctaaacaatacagtataacaaccatttccacagcatttacattgtattaggtataagtaagctagaggtgacttaagtatacgagaggatttccataggttatctgcaaatattatgccattttacacgagggacttgagcatccttagatttctgtatcctcgagggtcttggaaccaatctcccaaggatatccagggacggctgtatatgacaatcgctttgtcgggagccctcaaataatcttccccaagagttggcacagggataccaggaggagcctgcgtgatggagagaggcctgacatgcatgaaaagatgccactggcaacaaatatgttagtttcaaatattagcctcaaaatgaaagtcacaagggaagttggagaatccaaactgcttgccctgaattgcacgagacctgcttctcacacagacaacaaactctgtgtagcttgccgaaagtcgagaaataatagcagggatttaaataaattattttgaaattaaaccatggctagtggccaaagagactttcaaggcaaggccaaggaggccatcttctgagtaataatactgggagagggagtttgggagcagatcacaaagtccttgatggtcatcctaaaggaactgtgtcttatttcacagtccaaagggggccagagccacaatccagtgataaactcagcaaagtcctccaatgaggttctagaggaatccctgccgatgaaggagctgcatggctcaggcgcctttcagcaatgcctcccctaccaagcgtagccatggtagacagtcagcttctaggtgacatggagtgtctgtgtttctatcactggacgtaacttgctcaaaagccaacggcctaagacaaaatgatgtggtgtcattcaaaaccaacacacagaggatgacagctattagtgatacaagcacaaatctgtcacacaaaaataaaataaacgcaacaacaatctactagaaaacagccgaaaaacactttggctttgaggactttttggaaaaatttgaaaaataccagaactggtacatacttgggccgagatgtgtttgcttttctagcagagtatgagcaaatctgcactttgggtcaatttccacccaaaagaaatgtctggtcatctctctgccctgtgagactcaacccaaatgcactgaattcctcactttcatatacctcactttatgttcacacttggactggagccagatgcataagcaagaaatacagaggagtgaaaaaaatcatttcatccacacaagaaacctggggggcttcttactgagagtcaacaccgggatgagatcacgtgccgtgaaagaagcatcacgggcagggctggtgctaccgactgaacctcgcgcatgtgtgcgttttcgttttctgttttcaagagcttagcagggaaaggagagcggtggcgctctgttctggcacatgtggaagtaaacatcaaggctctaagggagaaaatggaagtatactaagtggtgccactcagggtttatgtgggcttaaaagtgattcttaacatctgtcccaaagggaagagtgtttccacagagctctcctcgtggctcctttttcattcacacatttactcagcacctggttggtgtcaggcactgggagggtatagtgctacagacctgagcaaattcagcccctggtctggtggaacttgtagaccagggaaggggacagacagctggacacccaactgtagcagagtgtcatcgttttacacaaagtagtattcaccttgaagcaggaggaagtgccacttgccagaggaggtggctttcagaaccacactggaggatgaagtgagtgtgcaggcccccagttgggctgcagcccagggggtcctacaggcagacgcccatggagatgggccttggcagtgtcaccctgtggtggactgggagccgtggaaggattccaagcagagatgaatacttcagaaaccaccttctgacactcgagcaccagtaagaccagccaggagggcactgccgtgcaaacagggggctaaactacagccccagccagggcctactgggaagttagcaggctgatccacaggcaatgacaggaggaaggaggaggcaacgtcccagacaaatggaaagagagttgtatcagtcatgaatagggggacagaaggcaaggagtagacttggtgaagtgctggaagaacaatggagcagctgatggcaattccagtgaggcggtgctgaatttagggcacacatacaacacccagtgagagggtggatctatggggtgtgaaggcttggtctaggctagaggtaaagatgtgggactcaacctattgtggcaagtccagccacgggttcatgtgtgacttggttataagggtctgtgcaggcagaatgccagagccctggagaataccaataacaacgagtctctggaagatcctgaggagtggccacagaggtgggaggggaccacagaaagccagaaaagggccacaggaagcaggggaggagagcccttcagggaagaggaaatcaaataagacaagggactgcactctttcctgaacctggcaaccagtaggtcactcctgaatgcagggagaggattcaacagaattgttggtatggataacagcactggactagggagtggatataaaagaacaggtgatctctctagaaatagctatggaggcggggagaggtagggatggaagataagcaggcacagggtcaaaggaggacagaacctcaagtttcctcaatttctctggcctcagtgaatttctctgaaagccccaagcattaaagatggcacccagcagccccaagtcacggaattaaacaccatttcatgttcatacttaaactttacagcaccagagccttgcaagtctgaaggtttgtgataagagaattttggaaccaaataaaatgctccttttgttaggcaatatttatggggcaagtatgctccaaggaatattaaaaataggtcttatgaaaaggggatgaaggattctgtcttagcttgagctgccataacaaaatactgtggacttcgtgacttaaacagacgtttgttttctcacagtcctgaaggctggcagtctgagattcggacgccagcatggttggtgactggtgagggcgcttttcccggcctagagacagccgccttcttgctgtgtccttatgtggtggggagaaagcaagcaagatcgctgtttcttcttataagggcactaatcctaacagaccagagcctgccctcatgacctcatgaaaccctcatcacctcccaaaggcttcatctctaaagagcatcacatcgggggttgaggcttccacacgagaattttgaggggacaccactcagtccataacagattcaatggccaattccatttgagaaactcggctaaacagtgtttctgcgcataagacttctcaaagcctgaaaggtgctaacatgcaggagcagacctgggagactgagtttgggaccaccgaactttgaccagggaacacttccgtttcccttagagcatcttgagagaagagtgttttgagacagtctgagcagtggcgaggggtgtcactccagttgtcagatgcagctgaggaaatgactcctaacaagctagaaaactcataaccatccctagttgggttcaatgacatggaaatttagggatgcagcaagatttcagttctcagatgtgcttctacattgacctgacgtaataggagttggtttgtcctttctacttggccttgacccagtttctggagcttgtttctatgtagattcattagctgcattattcttaggtctcttcaagaagaaaggcaagaggtagtataagaagttggaggagagggcagtagcaacagttgcttccttctattctgcagtatgtgttgcctctgctggggctggaaggctcggatccagaactcagatcccttgtctggcacagtttctagctactgccagacccagaacattactgcaacattaagccctctaattatgttttggagacaatctgtgaagaaatttcaaaatgaagagtgtgtgtgtgtgtgtgtgtgtgtgtgtgtgtgtgtgtgtgtgtgtgttttaacccatagaaacagcaaaatggagagagagcaagacctgccatttaactaaaaactacaccagatacagaatgtggagcttgtaaaccaccttgctatgttccagctgccatgtgacacaagcaaataattgctttatcagcaagaaattagaggaaaataaaagaaccatcaatagccacacctagccaaatttgttagcatttctcttcccagtcttcaatcaaatctattaatgtagatttgggacagcacttcatatacattcaggacaaactggttttgtgtcacagtaagaggtctatgaaggtcacaggcaatgtcgaggttaatcctctagctacggataaaaagagctgctacatatgtgcccagagcagaagcatcttcgcgaagacagcattccaaaaagcacactcagaggatcaggaaaacagcagaatcctgggttgttttgtttccttacattttgaatacacttgcatcatgttaaaaggtgactctgcacagaccaatgcacattctgtcacataccccaaacgtcctctaataggcgttcctctttgagaaaaaagtcctttcaaggttttcgtcccacttttataaacttcatggcacagatcagaaccacagaggctaaagcctaagtccccagtgcagcctggaacagcctttgttctgcttctctgactcctgtccccccttggcatttcttcattctgtgtcgtcgtttggccagaaaaaatgccagcagcaagatggggaactgccttcccagctctctgcgaagactcttaaggcagaagcgaggcctgctgggagaaggctgatgtcagctcttaagagcacagctccctgctcggataaggaggcctttgttttcagctcaactgtgaaaatgagaaaatgcctctagcctgacaaacaagaaacccacacaacacaggtcaggcctgtgacctttacttaaaggtaccacactccattagcaaaacacttccagggaatctgcagatccaagagtggccctcagagaagagcagctctgcttccacctcaggaaggcaggttacaaccctgaagcaaacctcacagagaatcagttcctcggtgacgatcctccctaatgggaatggaaacacacacaactgacatacatggggcaaagtggggggatgctaaagaaactaaaaatcccgatgtaacaacaatattgcagtttccacattagtaatttaggacaactacatttatgaccataaaatatcctcttaaatccccagaatgcctttgggaatacttgtaagatacagtatgaaagtaaagaatatagaatttcagcactgaccctaccaagtttagactatgccaaggaggcgtggcagaaagaaagagcagatagtttgaaggattccattccataggctttgatttatgaaatctagagggaaaaaaaacacatgtcttcaaatacttaaagtaaattataaaatgctccagtttgaatcttttaggctaaggttactattggcttgggccactaacttaaaattgggccacagattttaaacaagaattaaaacaatctaaaaagcagcttcccaagcgtaaagaaaacccttgtttgttcctgtgggattctcacctgtacaaagactcatttcaggcctcttgggggcagctggacagcactcccccttccacaatccctgagggaaccctggtgaggctgtggggacctggagtgtgccgaactactaacgtcccggggcctccacccctttacttccctccatcctcctttgtgtgtgctaaaatgaacagtccccacctcccaaatatcctcagtagtgtgtggtttgagagtgcttaggctgcatcgtcccaaactatcaggcattagggtccagtatcgaatgattcatcgcagttggatatgtgtgctattagcataaatatcccatggtggctgacagcactggctctaggatcacacagcctgagttttgaatcctggctctggtacttaccagagtgtgtgaccctgaacaagttacagaactctcagtgttaccatctgtaaaggagggataacgatagtctccacctcatagaactgtgaggataaaacgatcgtgcccatgaagcacgcagcacagtgccagcgcacaagggctcacgagttgctgttactaacaagccctggaaaaaagccctcccaattctctggatgctgagaatcaggacctatcatcattctccatgatgaaaagttcacctctctctaaagcttgtgtagacatgaacacaataacttgttttgcctataaatacacattactgtttacgacgtcccagctgctagcagggtcaagggactaaaataacctcagcttttccatttcctctgggttcacttttaacctgaaatgaggaattgcttccttcactctcatggaatttgtgaaatagtctcttggtaactggtccatatacatccaaactaaaggctctaaagacatagaagcaacagctgccaaagagggtatgatcatgttgccaaagattttacatccagataccaaaaactacagatactgcagaacatttgaggtctcatatatataatcaactcttctgcaaaagataaagaaaatccagggaaaacccccaatcccattttagccaatcatcaatttcttcttcttactgagttcctattatatgcccagcacctgatttcaaaggcttcctccaaccttttgttaagctgaatgaattcgtggttttgagtttgtttttccctctttttctattcacccctatggtgagaaaagtgaagtgacagggccaggaaaaaacaaaacaaaacaaaacaccagatgaacaatgaaggatgaaaggacaatgcaagcaaaggaagagggagggaagaggaggaagaggagctgcaacaggaaccggagagcccaagcctggaatacacactcaagggcacaccagaatcgggacatcgggctccagcaaacacttcaaaggaagcgtcatagaagcaaagacaacaaggggcccatctcacaccaggaccgtgtttcaaaggccccccatcagcgaggggaggctgcgttttctttcactgggcccttcctcgttcattatgggttgctcagtgggtctgtggcaaacacagctggatggagcacaaggctagtgaccatggctttgatcccagtgtgagcctaggggctctgccctattctgtggccgggggcaaatacactgtaaatatatactgctgatcaaagagaggatgcctgctccaacgggaacgtgggctcaaacagcacttcccctagagacagggtccaattcaagtcaacataaaattatttagcacctaacacatgccagacattggactggtcaagtgtcatcttaaatacatgatgtgcacctctaaagctgcatgtaattccccaggtgggatgtagctatggcatcatcaaatgatcactggtgttggtgtcacacacagcagggttaatcccagctgccaacaacttagacacatcatcctctcacaaactcaatttttgcttttataaaatcaatctgatatagacaaaaagacagagatagacagatagatgtagaaatgtgcctacctagtgtaaagggtcacaattattgtgagagttaaatgagataatatatttcaagtgtccaacacacggccagtctgaagtaagcactcaataaatgttcccttcctcacaggtgacacatcccactctaagtctacacacacacaggtgacaacctcttcatttcagcacagagccctctcaaggttctacccacgaagcagcctagaatgactctcacaaccgatatgaatttaccatactgttacactgcacccactgtttgccttcaagagttttaattctattacaaatacacaagatattaaaatgcacgaggtcatccattgcagcactgttagtattgtaaagcacctgaaattgccaaaatgtccaaacacaggggactggttggatgagctttgatgcatgcaggtaatagagtgccacgcagctgaaatccagagtgaggagctggtaggaaaagatttccatgatgtgtcattgaaaaacacgaaggcggccaggcacggtggctcacgccagtaatcccagcactttgggaggccgaggcgggcggatcacctgagatcgggagttcaagaccagcctgaccaacatggagaaaccccatctctactaaaaatacaaaattagccgggcatggtggcgcatgcctataatcctagctactcgggaggctgaggcaggagaatcgctggaacccaggaggtggaggttgtggtgagccgagattgcctcattgcactccagcctgggcaacaagagtgaaactccatctcaaacaaacaaacaaacaaacaaaataagaaaacaccaaggctgaagtgagtacacacagtaggctatcgcacatgtaagaaagaaggggaaatgcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattcccagtaaactatcacaaggacaaaaaaccaaacaccgcatgttctcactcataggtgggaattgaacaatgagaacacatggacacaggaaggggaacatcacactctggggactgttgtggtgtggggggggcggggaatagcattaggagatatacctaatgctaaatgacaagttaatgggtgcagcacaccatcatggcacatgtatacacatgtaactaacctgcacattgtgcacatgtaccctaaaacttaaagtataataataataaaataagataaaataaaaaaaaagaaagaaggggaaatgataaaacattcacatatttgcttgatttaccaaaacagaaacacaagaaggatgctttgcttccagggaagggagtaaaaggtgtgaacaagacagggtagggagtaacattaaaagcacactttttagtacagttttaactttggggagcatgttcatatcttacatactcaaaaaataaaatttgaaaggatggaaaaagtctaaaactgaatgcaaacagaaatgaatgaacctaacaatatatttcaaataatacaacaatactgaggagaaaagggaaagtaactcttcaaattcatcctgtgactattataccctcagcatgggagaaggaaaaaccataaacaaatcctgaactctttttagtttgtttttcaaagtggtattggcaccatgcttctgaaactacctgaagtgcactgcaggagtggaccatgagtacatgtgtggatgtagttcttactggtgaaccagggagatagagtatggaacggggagggcgaggaggagctcgggagagttgggttagccctggagcatcgccaggaactcattatctcctagctctttccatggaaaggatctagaaacagcactgttcaatagaacttcttgtgatgatagaaatgttctgtatctgtgctgtccgatatggtagcgaacggccacatgtggctactaagcttgaaatgtgactcctgcagctgaggaactagatttttaattttaatttaaaatcaacacctgtggctggtgtctgctgtactattagacaaatcaagtctagaagcaatgtgatcatagtaacaataagttaccatgaaaaactatgtaatccatagtaacgataacacctagcacctggatctgggcttctaaatcctattccccactaaaaggatctggagtcccctggaaaaacggctaattccatggctggagcaggtaggctacaagatgagcctagaacaacttgtaggccagaaaataagaaagtgctcaacaaccacaaggaaataatggaggttatgacaaggacataggaccagtggacagggttcttgtttgtcaactctgggacagctacaattcattcagtaagacaggaaccccggagtccatatggataataagtagataaataggcaggcaggcaggagaaaggggaagagctctttcttaccagattgcacttgaatatcaagggccattaaaaaaaaaacttactgatttttccacaagatgaatcccactccacctcttcccatcctttaatccactctttccaaacacagagtacttttcaacttccaaacagacattcatcttcttaagacttttcttaagaaataaacagaaataatgtatttctcagggtcaccgtattggaaccaacccaacagtgtcatggataggttaatggataaatgcagaaattgacctttctagtcttaaaacttaaaacttacatttgttttatctgaggtctttaagaaaagaccttcagtcctctcaaaaacaaaaaacaagtgtcaaagaactgaagcccaccaggtaactacatccagacaaagagatgtgggaccgtccttcatcatgattgtgtccttgctcctcccaagttcctatttgttaaatcttgtttcatttcttccctgctatataaaccccagctttagtccatcagggagatggatttgccccatctcctggactgtagcacccaatgaaagccttcttccttggcaatactcctcatcccagtcattggctttctgtgtggtgagcagcaggacccagaccaaacccctggtggttcggtaacaatatcaacaaaaaaattaataatgagttcaaatacaccaggtcctaagaggctggaataaaatcccaggaattctaattttcaaaattctgaagaaatcactaaggaaacctctctttttttccccttcccctaaatcaaactggatagaactcagtcttactctctgttgccttttttttttataagacatcatctcgctctgttgcccaggctagtgcaacggcatgatctcggctcactgcaacctctgccacctggattcaggcaattctcctgtcacagcctcctgagtagctgggactacaggcgcacaccaccacacccagctaattttttttgtatttttagtacagacagggtttcaccatattgatcagtctggtctcaaactcctgacctcatgtgatccgcccaccctggcctcccaaagtgctaggattacaggcacgagccacctcgcccggcctctgctgcttcttactctggctcagagccacctgatctctccatctttctactagaaaatgtctccatatgatgcttataataaaatgcagccaaaccgtgcacctttcaggccttgttagctagctaccgaaactattttttctttcttcctctctctctctcccttccttccttttttagaggcagggtctcccttttgtaccctggctggagtgcagtggtgtgatcacacctcactgcagtcttaaactcctgggctaaagctatcctcccacctcagcctcccaagtagctgggagcaaaggaacactccaccaggccaagctaatttttaaaattttttgtagagatgggggtcttgctatattgcccaggctggtctcaaactcctaggctcaagcaatctgcctgcctcagcctcctaaagtgctggaattacaggcatgagctagcacacccagccaaaactcttttccaataacactcctttccccagaattattatgactgctttagtgataaaatacatcacattttcattacatgttattaacaaactctaagaagataaagcacaaaaaccattttgtaatctccttaaagagatacactaggctattccttttcaaataattatgaatctgtcatttattgcagataacttcttaggcattaaatataaaggagggagcatgctatagcccaaataggaaacatttcatcaaacagcagcactaaataccctacaacacgaagaagtaagacaggcagcatctttccaatctgcctgtgaaatctgtcattaggctcttagaaaacacagtacaaacaatggtaatgttactaaaataactatcacacagtaaacaagtaacactcagaaggacctaaccacacgccaatcgcctttcctccttacactgtacacttaagaaaatacattttataatatatatattttttaccacaataaaagaaaaatgaggggggagtcacctggctggtgtaagggagtctgagagaggaggttactcctgtttctattttcctaaaactttgcataataatgtcaattgtgatttgcacataaaatttggcgattctattatttacacttaaaattatttatagtgtcatcacagacccgtacctcaaagtcttatttttagccaccaagagagctacaaaattattttcttttttttttttgagacagagtctcgctctgtcacccaggctgagtgcagtggcgcgatctcggctcactgcaagctctgcctccaaggttcaagtgattctcatgcctcagcctcccgagtagctgggatgacaggcatgcaccaccacacccagctagttttttgtaattttagtagagacagggttttgccatgttgcctaggctggtctcgaactcctggcctcaggtgatccacccaccttggcctcccaaagtgccaggattacaggtgtgtgagccactgcgcctagccacaaaattattttctgaacattttaatattctaataataatattaacaatgactaaagctgagtacttactatctgccaggcaccattcttaagtccttacaataatcctatgaggaaggaattaatattatctgtgatgaaagataaagaaagtgggaattgaacccaggcattttgattaaaaggcacatactatcaaacattaaatccaccatatatacatatgtatattttcttactctctatcatcataaccagtatctgaacaatggaataaaaataacaacccccatcaacaaagtgctataccatgccaagctctttgcatattttaactctagtcctcgtaatagctctatacattaactattatcattgtcattgtcattgtccaatgacaaggatatcactgtcaaggatactgggcccagctaaattaagtgacttgtccaaagcctcacagctgttgtgtggcagaatcaggatttaaattaaggcatgtttgtctgcaggctgccttcccctttcttacttatgaaaagaaaaagaaaaaaaaaaaaagaccaaatgttcttatttgggtttgggaaaagcagatgggaaagtataagaaattcgtgggaataaaagaatgaactgcaagagctgagcacccaggagttaagctagccctgcctgcggagtgcactgtttgcagggccttcctgctggattcctgatggtagcaaattccagggctccagactgcaggctcagcctctgactaacactgcagtgatttatttgaggataaatacctctgtcagtgtcttatgactgaacacaacagtccaagctgactggaacgagcggaatgcgaggacgctggagctgaggcagtagaggcgggagctgggccacctctctgcggaaactctgcctccaaggaggagccctcacaggaaggtattcctgtggggaaaaagcagtgccctcaggaattggagcatcttgaataatgaggaaacactgactcatgctagagtgagcgcttgggaagggggaaggaggaggacctctgtacctgcacacacaaagctactccctccaatactcagtgcaaccttgccaggattggcaagataactccaagaacaccaaccgccctcaccactgtacccgtagactctctgggcagctggtggggcgtctccaagtcctgaaaactggggagaagcctctccctctgcgaggagggtgtgtgccgagaggagagtgcaaaggggagaagccgggtgcacggaagcgggaggcttttccagtggaaacatggtgacgttgcacagattcagggatctgtggtttcagcccgtgtttcacaaataacaaaactgaggcccaaagagttgaagcaattcatgtcaagaaggtagacagtgtcagtggcagatcaaggactggctggatgtggtgagtggcaccttgtcatgagcataggaagctggcttccctttatgggaaggtcccaagtttgtaccaggggcacataaggtgggatgaacacttcttcgtgtgtacaatcctagactcctgagtaagaactttacagacgtctgcttggtcaaaaaggtgctgagcttcccttctatttgtctggtgcacagtgacattcactaaatgttgattctcctaaaaacaatcaatatgtatgggcaaaaaaaagcgaagcttagcagatgactactcgactgctcgcagaagctctaaggggacattaacttctatggagtttaacatgcggaaggtcctacaagtaggctggagggaagccagacttccacctcaccgcgagttatcaaaatgagtttactaccttctttttggcagatgaatactatttttcttttgtaaataatatccttttcaaataaagtatgcaaatgataacatcagaattagcacaaagttgcaaaacaaataaggccccagcacggagcacccttaagccaaaataagaacagaggaactcacagatgggggttgaagatgcgactcattttggagacgtggtcgttgtcacagtctaggtcctcgtcacctggctccatgctgaacttcctcttgctggggctgattgggggagggccggtgcggtgactgctgagggcagaggccaccggcagggtctgtattctgggttctcccctgagagcagcttcgcctacgcagagagagatgatgtagtcactaagcaggagaaaggcccccatctcagtcccccaggctccccgcccgcccagccagccccttacaaaactactcccagtggaaagtttttggcaatgggacggggccgcctgccatcctctgaacatggtttgagtgtggttagctgccaaccatgagacattttacatcaacgtggttttctagcacagtcactctttagggtagagtttaaaataaaaagttgcaataaaatagcaggggggaggcaaaaagcattttctgtaaacaatttcaaaagttaatttaaaacaccaaaggtcttttcacgtgtgggtattccactcgatacagataggagaatgacctcactgcattcatgaaaccactatgcccaactcacttttcctgcttgttctgttttttttttctaatatagtcttggtatttaatttcttttaaaagaatgaggaaagtgtgtgggctaacagttcacacatttgtaccgaaagttaaaagaaatataaatacatcgtttaatgggaaataaatgtttaattcttacagtacgctaaatattgcacattaaaatattatcagcacaaagcttcggcatataacttatcgcaagcataatacgtgggtaggtgcagttctgaaacatgtttcgaagttaggcaatcaaattagggtccacatttccatttgatttgacatcttggcgtttttcattattattttaaaaggttttgtactaggcaatcactttgtgcctcgctgtgaattaaaataagcatagcctttcatagtaataaagcttgtgtaccttctaaactttataaagacgaatgattactttaagagaaaacttcaaactttctaagtcacatggggggagcacctaaatttttcacaaataataacccttttgttgtgctgtacattttggtctctcggacctgaccaattttctttccatttggtcacaatttgagagtaatacgaggataaagtcaacttcatccgaggccttgtggtacctaagaaaaggaatctttgtttgccaccactaattttcatatcatcacagatgtgtggacagtgttaacagtcatttacttcatacacatatgacaaatatgattttgttggagaaaggagtgaggaaaaaccctctgaatatttaccaggaaaaataaaaacttggccaatttactcagcaagatataaactagcaaatatacagtgacccataatacacctccagccaggatttcttttaaggattctggccccaaagcaaactggaactttccattttaaatgagatacctaaaacacaggcctcacgctggcctgccacactcagaaattcagtatgatcttggttggcctatactccctatttagtaattttcattttaaaaaacaaaaaaagcagtgctcatctttataccttcataaattagaaaaatatcctttctaattatctccgttatttgtgatacttcctcctccacaaagagagaagagggtgtttccaagggaaagcttcagaagcccaagcccagctaactttctgggaagccctgatgatacccccaggaacgcagcaactgcaaatcaaacctcatcaaaatggcaccagctgaccctcctctccacccagggtttctcaacacccctggcaggatgcgaggggatgaggagtcctcgggcttggacccccgaactgtggtcatcatttcatcagatgccagctgtgtagcaacaagagttgctatggaaaacaaccactacagcaacagactgaaatcactccaaaaaaggagccgtcactcattccaccagcatacactgtgacgcggaaagcaaaacccttgggttaagaacaacattcccactcccctccccagtttccatcctagtaaaaattctcgtgcttgtttgcatttttaagttcatccaacggatgcagtgcttatctttaagactgaatcactgatgtctaacatcgaaaaaaattccacaagaatcctcagaaaacactggagatttctaacccacgggtgggggtgggaccagggctggggctacaggccccatgaaggcactccaggtgtccttcaccagggactgtgacagacgcctccaccaggtcccggggagacggtggtaaatgcgtgctgtagtacttcagcatctcagcttgccggcgccggaaggagcccaggaagcacggtttgcctcatttgatggatgacgaagctgtgccccaaaacatagcgtgacttacccaagatcctccagttaacaggttagctggaggcaagaacccatggcctctgcaatcagacaacgcctcatcctaagactgtgcagcctcacacaaggcttacagcaaaggaaaagaatccgcacataaggtcagggacaggtccgttcagttatgtgcctttatgcatctttggggcccctccctagatggccttaacccaacacttgtatgttagacaagagtggtaactgttgtatgtgtggtggggttaaaattatttttgtaaaactgaagcagacatttgttctgggagataagacacttgcattgcaatcttgactcctcctttatttaggatggggtgaatttgggcacgtgcttcccctctctgggcctccctccatacaacaaggggctggactagctaatgtgtcatgttctttccagctcttagaattactgatgcaattctatgatcaacaagtgaccaaccaactaaccaacatttacaaagaaattgctacttgtgtaatggtgaactaagacagcaaaactcaaggtatgtacctcagatgttattcatcgaaaaaaacaagggtgaccctggggtcaaataaatttggaaaccgtgagattgaacaacttttacaggagtttaactacaggcctttctgtcttctaatgcatctcagtctctgagatggaaaccccgcagggctgctttccatcgcccgccacgcccccgcccacccccaatcctccacagctctgtgaattccatcttccaaagcgcccccacgcccaccccccacccccaatcctccacagctctgtgaattccatcttccaaagcgccccacgcccccgcccacccccaatcctccacagctctgtgaattccatcttccaaagcgcccccacgcccaccccccacccccaatcctccacagctctgtgaattccatcttccaaagcgcccccacgcccaccccccacccccaatcctccacagctctgtgaattccatcttccaaagcgccattctcagcatgttggcccatcctcaccccagatatccagtgactgcagacttcttctgcattcgaaaccccaactgcctttctcatttttattcctagtattcctctttatgagccctgaaaatttcagcccagtaagttaaactagactcatcaccattccacagagaacttgttcttcccccaatcttctcatttaagttcatacatcctgcaaaaccacttaaaatgcctcctccatcaggctgtcctccttgattcctccagctgaaggtcatctcctcttcctctgaacatctatagaaacttatcactctggtgcttccctccctactttattttgtgctcctggaagcaggtggcatttaattcatttaataaacctgacagtgcagagcacaactgacctactgaatcaatgaggcaaggtgacagggtgggcagtttacagagctttaggatatgttaaagatcaaagatgttatagaataaggagtgtttaaagatctatttaaaaatataagaactcttacaacaattaaaaagataacaaaaaatagaaaaggatctaaataggcatttccgaagagaagatatgaaaatagccaataagcacatggaaagatgttgtattagtctgttctcacgttgctgataaagacatacccgagactgggtaatttataaagagaaagaggcttgatggattcatagttccacatgcctggggaggcctcacaatcacggaggaagccgaaaggcatgtcttacatgatgacagacgagagaatgagaatgagagaaaggggtgttcccttataaaaccatcagatcttgtgagacttactaccacgggtacagtatggggggaaaccgcccccacgattcagttatctcccaccaggtccctcccacaacacgtgggaattatgggagctacaattcaagatgagattgggtggggacactgccaaaccatatcagatgtccaacatcgtcagccatcaaggaaatgcgaatcaataccacaaagagataccactaacacctgttaggatggctatgatcaaaagacaatacaaaagtgttagcaaggatgtggagaagctggaacacgtgtacgctgctggtagaattgtaaagtggcattgagaggtgaggccagctggacttgtaggttgggtgaggacttagagaacttttctgtcttacaagaggattgtaaaatgcaccatcagcaccctgtagctaggattgtaaaatgcacccaatcagtgctctgtggctagctagaagtttgtaaaatgtgccaatcaacactctgtaaaaacacatcaatcagctctctgtgggtagctaaaggtttgtaaaatggaccaatcagcactctgtaaaatggaccaatgagcaggacataggcagggacaaataagggaataaaagctggccactccagccagcagcagcaacccactcaagtccccttccacgctgtggaagctttgttcctttgctcttcacaataaatcttgctgctgctcactctttgtgtccgtgccacctttaagagctgtaacactcaccgcgaaggtccccagcttcattcttgaagtcagcgagaccaagaacccaccagaaggaaccaactccggacacagcatggccatggtggaaaacagtctgacagctcctcaactgatgaaacacagagttaccacataacctagcaattctagtcctgggtacataaccaagagaaatgaaaacaatgtccacacaaaagcttgtacatgcatgttcatagcagcattattaaaatagctaaatagtggaaacaaccaaaatgtccatcaactaacagatgtaaaaaatgaaatatccatgatgtaatattatgcagctataaaaaggagtaagatactgattcatgccatgacacagatgaacctacaaaacagtatgctgagtgaaggaaagcagacacaaaaggccacctactgtctgattccacttctatgaaatgtcagaagagggaggctcacaggcagaaagcaggtgagtcggtgctgggggctgggagaagggggaatgggaggtgacagttcacgggtggcaggtttctttgggggaatgacaaaaaccttctaaaattgattgtgataaaagttgcataactctaaatatgctaaaaaccactgaagtgtattgtagactttaaatgggtgaattgtatagtatgtgaattatgtctcagtagaaatgttacctcttcctcctccaaaataagaatatatttataagcagtataaggctccaatatcattagattcttttttctctcaggcttttcacactaaactattaaacaattaagaacaggcatttgtgaatttccccagaaataaaaacaaaccttttgttattacagttacatctccctagaatattaaagtcagataatttttaaaacattatttattaagctaaaaaaagtcaaatcagtgaaacacttgaggtgacttaggctcttggattcatcagatcctataaagctgcagctcagcttttaatcagtgtgtcgagtgcctgtgacacactgaaggctgtgcaaagtactgtcacaaaaatacatgatgaaatgtatacagaccctgaccacaagggtgggaggcaaaagcacatacaccaaaaggaacttatcttgggagtgcaagaggcttttccctcttgttctaacatgtattcgaaatttcacaatggtctggcaattgaaaaaggagaaaagattatctttctttttcaagaataaacagaaggaagatttgagctgagtaaccccgtattttaagctttacaagttggcttaactacaactgtcagttttacttctttcaaattcccaatgacaactaaagaagttttattttttaaatgtatttggccttttacatgaagataattttatctaggcacacgttagaaaaatgcctagataaaatgaagaaaaatgccgaatatatacaaaattaactcctgtggttttttggcatggtggcaattctaacacatggatcaataatattccttcaaatttccccaaagaagataagcaaagattttggcctaagatttcacaagaatcagcatgtttatttcaatggcagagaagtttaacagagagaaatgaaaagagagaatcacctcgctttatgctgtgctataatatgattttgacaaaatatcacaagaaaattctgctttcaaagtcaaaatagaaagaggggaggagaacagggaggaaccgtggaaaatgtaaccccactgtaatcctgtcattaccatatctcaaagattctaagactatttcctacattttaatattgctaagactgaagtttatcttacaaataattggcatatattaacagccaagattgcttctttttcagtggtacataaaataatgattcacacagaacctaactccagaggcttcaaaacagcactggtctcttcaacctccatttttttttggagacggagtctcactctgtcgcccagactggagtgcagtggcgagatcttggctcactgcaacctctgcctcctgggttcaagtgattctcctgcgtcagcctcccgagtgtagccgggactacaagtgctcgccaccatgcctggctaatttttctcaaattttttagtagagatggggttttaccatgttggccagggtagtctagaactcctgatctcaagttatctacccaccttggcctcccaaagtgctgggattacaggcctgagccaccgagcctggcctaacctctgtttctttactcacaaaattaagtggtttgattagatcatcttgacagcctccttttggctctaatggactacatcttccataagagatacatcttctaaagttaagtttccttttactgctcatcaagaaatactttccaaacttttacagaacacactttacatagtggtagaaaaagcagattcaacaaagcaatcaactaacaaaattttttgagattagctaattattagcatctcatgattaagggagatttcattaaaaaacaaggactcttctagttctcaaagttccagcaacattcatttattcgaatactacaagaaagttgtagccagctgaaacctggacaaatagaatctggttcaccaaatgcagattcgattttcatagaacagaacaatcaaggccatgaccttcaacacagagatggggcgagtgattgggtttcagggggattaatggactctcccagggataaggcggcgttagcaatgggaacccgggtctcggccacatggcccctcaccaactgtgcaggcccatcgccagactggggtgtgggctgcatgggaggcgatggcatggctctgagcaattaaccaaaataatggtatttatgggcattttctggagattagaccaacagcacagggtgaaatgagaatgtctttatggagaaggagagggtaaactacagtcaaatgtatcttgctgtaacttttaaggatagatttttgacaaagatctctatgccgtgccgaacagagagtttaagtccacaacttaaatctccgctgtgtctaaggctttacgttcagcccccctcccagcccctttatcatgtttgaacctaaatcaaagaagcaaaaccatagctcggtcggccaagccagccgcgctgcactgatgtgtctccttcaggctgaccacagcccatggcaaccgactgacatcatgtcctggcgagagggcaccctggtaagaggaccctgctcccagattccacgcccctctcacatctcaccctctcatcactgtgcagggcagaagcccccggcagccagggcttactcactttctttcaaataatacttctttgtctcacggtcgagcagctggggagaagacaccgtgaagtcaatctccttcaaattgttcaacttgtggctagccccattctggctcacttttttctttttttataggacgcccattgcaatgcgagccggcagataaaagccgtgacgtgctgtctgcccaagcgcaaggatcgcctgcaatcccccagcccttgggtggcaacacaaagcacctctcatactataatgctctgggcggccccaggctcagctctaatcgtgcagagcctgacctcgcctcgggggagccggctggactgggaagggctgtgcagggtccacaccctggactgggcttggtttgagcagctctactctttttgtttaagagcaaagatgagattgtgttgagagagtacagcctctatcttggactgctaataatatagataaggataacaacagcacaataaaactggtagaagtgaagcatatgccatcttcactagaatttcaaggaatctaaatcatttcatacacactatactttgtagaagccttcctgtatcttctatgagtgtgttttattttataagcgtattacaacatgatctattgttctgacttttcttaatgcagccctgtgagggaggcggggaagaagagctcccgccttgcagccggggaaactagtgtttcaagaattaagtgaatttctcaaggtcgcaaagctgattaatggaagcactggaagtagaaacctgggatttagactccccaacttccatcatctttctaggtgtgcaagatgcttcactggttgaggaaaataaatgggaggaagacagttgaggagggaggaaggcggagaagagagggggagggggcgggaggaaggggagcttattggctgaaccatgcccacccctggaattaacacgttaaagtcccaaaccccagtactgcagagaacatggctgtatttgaagacagagactttaaagaggtaattaaggtgaaatgaggtcattaatccaatctgactgttgtccctataacaagagattagggcaaagacacattgcagaaaggccaccatgcgaggatatgggagaagagaaggcggccatctgcaagccaaggagagagcctgccggagaaataagcccgctgagtctttgatctcagacttccagcctccaggaccaatgagttaatacatttctgttgtttaaaccacccagtctgcggaattttcttctggcagccccaggaaactaatccagagaggaaagaagagaggacgggactgaaacctggttctgacaccaaagatgaacagctgcaactgtcccatctgtctgacctaacatagtgggactgagatgaaagcaactgaacgtacagatgccgcttccagaccagaaccacctgagcacaggaggaaacaaacacatggactggcaagggaggagaatgggtttcctggctgggcactgggcaagtggacagctgcggcctgcccctctgacttggtgatcatctgccctgcactagccagaggaacctcgacctcccaggaattcttctgcttgcctgtaagagaggaggactaggtttgtgttcacaaaccaggctggggcctcctttggatggggaggcagtgggtctgaggtgggacctgctcccagacatgtcgtactgatgatactggtgcaggagggatggtgtctgctggcgcctctggttttaagtattaatagctataattttacaggggctgaagggaaaaagataaaagaatgccaaagaaattatgtctataattctcaacatctattgtgaatatacactagttttttaatgaactgcagttactctgaataccaaaaagcactaaaaatactttaaattaaaacttgttatcacatccacacattgttattcatttaattaggaagttctatactgcttaaaatcattttattatcttcagggctaatagaagtccctgctgtctcatttaccctgttggatttagtttacaactgaactgtatcttgatagactatgtaacactgcaacctccgtggaattgagtaagtggggtcaaactaatgtcttactatacatatcattttggcttgaagaaaactcaggtatgtaacacaacacaaacagcctgaagatcatcagatctaggtttgaggttgggttttagctttgtaaatcataagattcaaaaagatcaaacacaaaacaaacaaaaaagaatgaacactcatccacttccctggtttcccgatgcagatttagtaacgacacctaccttctattcttggtcctccattccctagactctggctctcaggtagcctcagaggcctctgagtaaactaggaaagtgcagtccccgcttagagtgcgagctccgctgtggctgtgctcgtgcaggctaaggactggcatctgcctattagaacagtggtccaaagggtcacatgcactgacatggccctgacacatcaccggtgaaccccaaggagacaaagccagctcagaacctttaacaccaagtgcacagtcctccttaatggaaaaggctcttaaagcctggcagaaattctgcactatatttacttgcaaatctacttttgtaacattttactgttaatgaggaggaggagagttatgaaagtaaattgttagcagatggtattggaatcaggcactttgctgggggctcaatttcctccctggtagagcttataaatgtttagaaggagtagctggatgagggtaagcaaaaaaaaaaagaggcttgttcaaacctcttcagcagttgagccaagcctccggagggaccctggttgccacgaaacagagggattaagctggtaatggtatgatctcttcaaaatgtaagtgttttggtaaaaatactcaaaaaacttctgtctgcaagccctgtaccatgtgacaggttaagcaccgaaggtcatatgctaccatctgcattttcaagacattctttaattggagggagttccagagggtacgactgccacaggccctgagatggttgagtcctggaatcaggcactgatcactagagggggaaaaaagagacacagtcttgcaagtgcagagagagaacagaaaactaaactttccctcttctgatctcccgtaacactccgagcctctagaatggccctgcccacaggctgcctaatggaagaattcaccacgtgctgctcttctctgtaatacctcgcacgtggtcccgggtactgttctgggaggcacggagcagctcattcatttctgtatccctggccactctaccagtgacagagaaacatagtagaaagtgggctgtggagtcagaaaaatgtatgatcttagcagtctcttcatctctcttgagcctctatccaactaccgtgagggatttctatgcgaatcaatgagaattcatataaaggtcccagcccagaacaggcaatttatttattacactgtttgttggattccatctgttggtgcaattcccatttgaaggataagatggctgaacaaagggaacctctaactgtccttctcgctactcatgacaggcccccgcctcgaatacagtcagccactagccgatggaaggggtcaggagacacagtacccaagagcctgggtgagtgggtgctccgaatctgctccaccaggagccggcgacgtcatctcagagcagctgcctgactttctatgactgtttccacatgtgtgaaaatggtagtgtgaacccacacacaggctcagagcgatacccggcacggtgccgcctcctccccacacacactctggacttacaggctttcttccatgcacgtttctccctccctagaatgtgttcagaagccctctctgccaatgcatactcatctgcactttcaaaacccgacttgagtgcctcttgtcagcctcagccccaagagcaccccttttggtgccatctacctgggctgagctgcctggcagcgtcccttgtgacgtgctgctggctccaactcaaaaactactcatttctcagcaacaccattgtgtgctaccgccaaacaggcgatcttgctctctgcagtaggttccagtccagaccctgaggagtaagatggtggtcccggaaaccagttcaaatttctcactggcatacagagtgctgaaggaaggctgtgtataggccccccgattctgatcgtgaaatctcattatcagttccaagccccccacggagctgcagtgggcaggtagctgggacgagacacattcccaagtcagatatctcagccagccatccaggtttcccacggaaattcattaactcactgtattccttactattgctaaatatgctggtttcagaagccacagagtgaattttccaaggattaaaataggacacgaagttcaaagatgtctcagtcctgacacagtggaagcagcattagggacttgggcacgcacaccattcgagagcctgacaaccctgaagacaagtaaagcgagtaacttaaagtcagcttcagtcaaccttactgctgaaacagctacatgcccaagtaaatcattttaatttttccaacttttaatttcaaaaaattttaaagctacccaaaaagttgaatgagaacaagaacatcccattctctttaccttgattcacctatcataagcatttttgtcagtttgttttagctacatgcatacacgttttcttgctgtgatttttgaaagtattaataagtgggagacatcttatttcacccataaatacttaagaacagggacattctccttcagagccacaataccattatcatacccaacaaagttaaagttgacgtattgtcattatctaatatccagttcacattccaacttcccgaactgacctgtctcttttttggtggcagggagggttgggggaggacttcattaattaagggtcatatgctgctcagtgaagttgtcatgtttctttaatctcctttcatctaaaggaattcttttctctttcgtgacactgatgtttttaaataatgcagaccaatgagctgtccctacaaattttggtggcctaatcatttctttatgattagatctgagttaaatctttttggcaagaatactacccaggtgatactgtgtgctcccaccgcactgcaccacaccggaaggacctggcgccagcccatcccatcactggggaagcagagcctgcagtacacacagattgctccttgctctgttagaaacaagtaagctcctcccttttgtagtaatagtttgggggtgtgaatcctgtcattgtcactcaatcacatactcatttttttgtttgggttctgtttttctattatttttatttcccatactcatttattacacacctttaatttgcagtttgagagtgcagagctaagctggattaaagacagggtccccagatacaattcagcacaagtccaactggggacacattttcatacaaaacacattgaaagaaagacagacaatacaatcaggagtagcttatactctgcctggaataaagcaggtgcttagcaaatatttgttgaataagggacctgtatggttcaggcaaataaaagctattaggccaatctgcatcctttccattcttccttctcacatcacctcacccctggggctgaaaggaagtcttcgaacgtggccaccctgcctcccaccacgagagatcaggatccctgactgattggattgccggagtaaaggctcaactgcctcaacctgatcagcccatctcaccctctctctccagccttacccatctctctttctcttccctcccccgcccctcagactccactgctcctgaggtgtggtctgcacacgcaggggatgcctcccacctcccctcccacctgcctggaacagtccctcactttcaggtctggtctagagtgcaagcctcaccttcttcaagctcttcctcagcaagtaagtgttccttggtcttcagtgtctgaaaacatttacaagcatcctgcgttatggctcttaatcctatcgcctaacggtggtactatttacaaacattttcacatggctaggaagccttcaggccacttcctagacccagctcattccctagggcctcctttcctttcctagagcaggctccagggataagccctgtccttgtcctttgctatgtcctttcataaaagctgccacccatgctctcttattgagacagtcctcatcccaaaacgatagtgaagtgggacttgtgtccctgccacatcaccccaaaaactgacacatggacatggaacctttatttaaaaggctaattgttgaatccagtcctgtctaaagaatgtatacaatttaggactggcagaaaaaaaatcagaggatgtggttcagtgaaaggcattgttgtgcctgggatgtttgtaggactactccaggaactaaggaaaacacacagatgtttgagatctggtctttgcctcgaaaattttagttctagtgggagtgataagttatggagataaagaactgtaaggatggaacattataaatgccaaaataaatcagatgctcttgaaatgggtgaattgcatggtatattagttatatctcaataaagctgttacccccaaagagcttctggttatgtaggttaatctactgacatttatcatagtaggaattaaaatggggaagttttaaaatattaattaatttgaaataaaaaataaaaagagatgcactttttatttttttaaaaaaagagagcgatgccacacacattttatatgagggagacaataattctaactctaacaggagtgggatttgaaaaacaggcaggatttggacacttagaaatgatgggtatgagcattccaggcaggtacaagagtatgaggcaaggcagagagcaggaatgatgccatctttgtgcgagagcaatgggactagaacaacgggtttgtttccttagacttaaggctggatacagagaggtgggtcagataataaagggctctgaacacaggtgaacggctgagacctgacgaggcgggtcactgacagggagccactgtaagcactgacacagctacagggaggcttccgtgaggggtgctccaacacaccatgccagatgggtgcacacacctgagtcagggaacagggcagggacgcaagcgttacgtgaggaagcttcaacaatgttcctatcagtgaggatggagaagaggcaggttgaagacacattttaaggaaagatcagagagctggtattccagctagtattatacattgacctgatctttccgaaacaggccaccctcagcttcttcctaataactctctcaatgttgacccttccttcgtataaattgagaaactatgagatgaacaagccaggaagctacacttgttccctagcttatcaatatgtaacaaggaagagtgagttagtgctagaactccatattttaagttccacaggttgatctaacaaagtctaattaacctctcatatttacatttcaatcactgtcaggtgacgtttttatgtactaataagattccatttttattcttgaagaaaactgtcagtatactcattttctttaaacaatttagatgtccactgtttgatggcaggggttgtgctaagagcttccatttatccatgattaatcaacatttattcaacagacatttcctaaaatctgagttgtgaagaacatcaaacaaatcaaataataatgcatacttatagagggaaaaatctgaataccgatgtttaaaaactgactccaatgaaatctacctatattaaaataaaccaattctaaaaaatcatcatccttcattagattggtgtcaggctaatatacagatatgttgggtttttcacagtatatggtatattctggagtgcttttacagataaattttactcaataattatagtttatgtaagctattattacaagatgtctgtattatccaataaaaaaactaagaggctattagaactgaagtcaaaagtatgtgactagcttgagaaagtattaaaatatttattggagagttactggagagtcaaacagctaatttcatacatgggtaagtaattaaataccaaaatgtatttatttcttaagaaaaatggcttaataatggtgttcagcataaccaaagaataggtaaatctgtaaagctgctttttaaaggtgcaattgcagacttattccacagattttaatgttaatgggaaatcgtaagatccttatgcaaaaattatacacaatcaaggacttttgtttccttaccaagctccaagaaaagagactattaaataataaagtaaaaaagtcatagaatttaacctgaaaacaaatattccattagcatgtaaaatttaatgtgtttcctaaacaaaatcatccccatgatgccaagaagttttctactggagtgtgaaggtgaaggaggtttccccaaattaatcaacctaaaatattgggggatggggatgttgcttacttttcatttctatttctttctatcctcccacctctctctctttttacatttacattacccagtgagcaaattttatcaatgagaagccaggaagggctgactccctttggtatatttacttaagatataaaggccaatcaaccattgtgctcagaaaagttgtggccgtttctgggcctacttcagatctctccttagctccaagtgacttattatgaagccaaagaaagaggaaaactgagctgatcaaaggccaggctgtcattaagtgaaaatgatggaagatgaaaggcttgccctgcacttcaaaggtacagctgagctcgggtgagctgacagcaagcgatcagggatcagagaggcaggcggtagcttaatggactagatgacattcctagagccattcatctttataccaatcacgaaaaatagaaacataacgacaaacatgcatttaaatgctttcctactggatataaagaagagtgggtaacccaaaaatataaagtgacatacatcacatctacacttacagaatataaaataatgaggtccaagaactgttgaagaagttggcatctctaagcagtgcagaattacatgttaacagtttttccttatgccctagggtgtgtaatgcaatgaagcttaattttgagagaccatggatgcagcagtctcacttccctggtgggctaacgcagaacacttggtgtgttgacgcggaagggcggtcaaacttgcttaagattttggggttagagctggtctagagccaccatagggctggggaaggaaggttggaaaaatcaggccgattgatgattacacaatattccccttattccaccccattcacccctgtacagtgccctcccacccatacacagaacctcagcagacagaggcccctctaggcagcaaagatgttacattgtaagaggcctcaaggcattaactcgagtctcctttcttttctttttcctctgtaggaaccaacatgcatctaatcttctaagactccctagaatgactttaatacaatggaacaatattatctgtacttctggtcacactggagacttttcagggaattgactgggtttctcctccctatagtttattgttagtggtggcagcacctgcaaagagcagagaaaaagaggagagagtgccaccccccggcaaattagtaatcaggatgttgggtactgagaagagatgctctagaagctttatatatgtgaattcatttcgtactcctatttacctgtgaagtaggcactatcattagtttcattttcaggaggaaatggtcaccaaaagtggctcagcaacttgcccaaggtcacagctagaaataggaaagactggatttacacccaaaggtctggccccagggactatgtttccaactcctataccactcggagaggtttcacagagcagatggtgaagggtcagcaggagtggcccagtgaacaaaatcctgcaaggtcggcacagcctgagggggcaacagcacagcacccctgagccagcagggtgagggcaagggtgaagagcagcaaaaggtgccggagggcagggtgagccttggtcatccaaaggcgttagcaccccagggccgctaaagtaaacattgatcatacgtaaaacctttgcttgcacctcttccaatcagacctgccactaccaaaactctccttctctatggaaattccagagctaccttttctactgagccacgctaaataaagagctgggacttacttcgcggaaaatttgggagccaatgacaacattcaggctggacaacaataaattcacaactccccttggccatctctgtcctgggcccttgctgaccggctccacctggaattccatcccctccttccctctcacccccaggacccgaccgtcccaccctgtgtgcacatatcatgctctgtaaagatcatctgaatgtacacgtaggatgtcagtttgcttcttgtaagatagctagtactgattataaagaaaacaacaattccagattgtcagctcctcaagaagggccctgggtggggtgtccagagagcagcagtgaatgccccttaccaccagacacaaagcctggcactcaggtgttctctgaatgaccgataggtgccattagtaagatttataattgagctaatactttgcacaatattttaatgtaagcaaatgcacacacacaaagaactttgcaaagaatggaatgaatggagcaacaatattctccacattaagtctccaacttttataatagctttattgacatataattcacatgccatataattcacccattaaagtgtctgactcaatgtgtttataattgtggggctgtgcaacaatcaccatgatctaattttaggacatttcttcaccccgaaaagaaacccatacccattagcagtcactccccatattctcctctctccaatgcctagcaaccactaacctactttctgtctctatagacttgccgattccagacatctcatataaactcaatcatataatgatttggtgtcttttgtgtctggttctttcactcataatgttttaaaagttcatccatgttgtaacgtatgtcagtactatatttcttcatattgccaaataatatttcatcgtatggagaaaccgcattttatccattcatcagctgatgggtatttggattgcttctactttttggctattataaataatacttctatggacatttgtggacagatttttacagggatgttttcaattctccagtatgtacctaggagtagaattgctgggtcaaatggtaactctatgtttaacatttcgagcaactgcaaaactgtttccaaaacagctacaccattttacattcccaccagcaacgtatgaggcattccaatttctccacatcctcaccaacacttgttattgtcttttttatttcaaccatccatagtaggcagacctcactgtggttttgattttcattttcctaatgatgttgagcatatttttctgcaattcttggccatttatcttctttggagaattgtctattcaaatcctttgcccatttttaaataagattatctgcctttgtactgttgagatgtaagagttctatacatctcaatacaggtcccttctcagacacatgatttataaaaatattttcccattctatgagttgtcttttccttcaaatctattattatagttacctacagccttcagaggtaccaacaagaaacctttacaaaaacctaaccttcatcttacatcttttacaaagcttacgaatttgattacaaatgttcttctaaatgccattatcttcccatccggtttcttgataagccagcctatgctgaagccccagccattgctagatacccaccaccgatagctgggtagcaaactcctggataataaataacagtgatatttaccactgacattctggcatttcagaaattcaatctgtcttcccaatgccttattttaatggtttttacaaaaaaaaaaaaatcatactattactagatggcagaacctaatgtgtgtttggccagcctattttctttaaagccatgctgacaatgattgttaaaactgctcccatgctagaatgctcctcaattgtttccgtcttgacacaaggtcaatggggactagagtaatgaagaaataaagcaaaactgaaacattttaatttggggtctacaagactatattaacttctagcaaattaaatggatgagtggtttgcagccactgacatttatatttcacgattagttctctaggccccttattctctctgcgccattaacctttagggtgtagctctttgtcagtctcacttcaattatgctttcgagggattatagaattagcaattccagttttgatggcacgagctctgtcaaatcagagagacagatgtgagctcatgtaactgagaggcttccatctgttggactgagaactgaaacctggaaaggctcttgtatttcctttcttacgcttccttgggctgttccagcttggaattacccatttacttacatacttggtatttgagcaaatatcttaaatagctgaggtagcaacctttcttgccaaaggtggatggctactcaccatccaccttttagttatggattccaatgctggtgacagaggagaaagtgatgtcacctcatacatatccaaatcctagcatccacaggaacccacacagaatcaaagcccctcactaagttaacaggtcatccactgggatcacatcaaggctctgtcgactggctggaaggaacagaaggaagagcccatggaacagaagcagcaaaggattttattttcagcagagtgaaaattaggtgttgtatactaaagagaaattagtcatcctttggtatatatactcaggggattggttccaggaatcccaccaatggcaaaatccacacatacccaagtctcaaagtccactctgcagagcccgcttataggagaagctgggcctctacacacatgggtttcacatcctgcaatattttctgtctgcaattggttgaaaaaaaatcctgagtcgaagtggaccctcgaagttcagatggtattgttcaagggtcagctgtgtattctttctgtcagggttttctgtaagttgggaatgctgaaaatttctacaactgtctaggtctaactgtctgcaggtgacaaatgtatttctgaaaattagatagtaaattaaacctgatcgtgatttaaaggctctgctgagctcatatgtaaagcaaaagtggttctcagtttaatttcaccaatctgtgaaaattttctttttttttttttgagtcaggatctctgtcacctaggttggagtgcagtggtgccatcataattcattgcagcctcaacctcccaggctcaagtgatcctcccacctcaacctcccgagcagctgggactacaagtgccctccaccacgcttggttaattttttgtattttttgtagagatggggttttaccatgttgcccaggctggtctcgaactcctgggctcaagtgatcctcccacctctgtctcccaaagtgctgggattacaggcatgagccacagcaccggggcaaattttccttattgtttttcatccagccactcctatttcatgtctagtacaatgctttccaaagtgagttcctggatgacctacgtcagaatcacctaaaagacttatttaaaacacatattcctaggtctggctccagtcctaataaaaagttgtccagggacccccacgatatgtcattttagcgtgccccaagaggtgtctcttctcatgcctcttccactttcacaactgatcaataccaagatcagccaacaccacatcagacatttctaaggacgtgtcagcagtgacgtggcacatgggagaactgatgatgtatctcagtactcacatccactcaggaaatgcctgatgaacgagtttcagaaagcaagatttaggccgtcctggttacctcctgccagcactaacacgtgaaacagctcaagaccagctttaggagggctcacctctattttcaaataatgacgtctttctctaattttttttttaatgtttgcctcttgagagatcagggacttcattaagtaaccctcccatgcctcagtttccccatatggaaaatagctatactatctgctgccttctattcctataaggcatacagtcatatacttcctatttgtcttttgcacaacaaaacaactcattccccaaaagctttgaattaggcttgcaaacatagtccttaactaccaaactgtaaatttctcaaagtctagaaaaatgagaggggcaaggaaagaaacaaaaagaaacttaggcttaactgtaccagctagtctcaacttgatccgaaggaacactgctagcattctctcagctagcttctcacgattacatttaaaaccaccacaaagccaccacgatcacgctctgagaggccgccgcaggtaaacagagggatagggtaggaacagcccagcataactgacaatgctctttaggggatctgcagatctgccttctcaaacatctcatttcacttcatgaatatttacaaaatatttgcaaaagaagaactaaggcaatgaacatgtccagaaagaaccacatgctaacttctaaaggtttctctctccaaaaattcagtagtgccagaggcctgttcttttgtcccaggttgtttttcaagtgctacctcatgacagaatggatcactcataataactagatgttagcatctgtgtcacataattcatctctggcagtccacttcttttaaatcctaatagtaggcctcctaaataggattgctagcatttggcatctcatttgcctctatgacaacaaaactctagaagacgtagtttataatacattatggtttcagctgaatgacatttggttctaaggtctttgaaagtacaagtttgaaaatgccaaattttatctatatccatatctatagctccatctgaaattagacagattaccaaacagaaaatgtcactcagattctaaaaataaaccatgctattgctccagacaggttacaccagagggttaggaccatgacattttgctggggttcaagtgcaaatcagcaaacaaaatggcatgtttttctcttcctttttcacagctaaagattagtgaaggcagcattgtagtctgtgtaactgctcaacccaacctttatccaggagctagtattgcttctttaaaaacattttttttttttgtaaataaaatgtggtacagccatacaaggaactactactcagcaataaaaaggaatgaagtaacaaaagaccaaatattgtattattccatttatatgaaatgcccagaataagcagatctatatagacagaaagtagatctgtggctgccagggaccagcaggacgggggaatggagagtgaaacgggtcaaggtttcttccgggagtgatgaaaatgttctaaactttgatcccagtgataactgtacaactctgtgaatatattaaataccattaaattgtataatttaaacgaatgaatggcatggtgtacgaattatatctcagcaaagctgttaaaaatcttaacttaaagaaactatcatcttttaaaagctatagcagaaagagagccagcactggagagagtaaatatggtggcttttcacctttccaagaatctcaatgagccctgggcattgcaaaaattagtcaagcaactgtcacaactgcagtggtaaccaaatacggaagctgaatcaaatacggaaaggaaattcttttgaactcaaagacacaacctttccaaaaaaatacactgcaagcacacaaacagaccacacaaagtcaaaacaaaacaagtacctgtgtgggtggaaatgtatccaagtgccactcttttcttcaagtctttcattctcctcttattacttcaaagataagccctggatgggcaggaactaagttgttttggttttttctcatgacacaaaagatctggcagagctggagatttcattaccttgaaaggcagtaatatttgaaggtaccatgactattccctgaacagtgctctaaacacattgtggtggctaagagctatggttatcccacctcttcaatgagaatggggcattcattctacagaaagccacttacagacaaaatgggtatcacatcatccataaaatgaagtaaagaacagttggctgaaacttcccaaacagcccgttactccatgtgatataaatgggtttgcaaagctcaacaaaggaagacaagcactaggaaggcaaagccagtcttcctagcatgataaccaaaagtgtctcagccctctaaagagctctaggatctcaaatcatgtgcacaatacagagaagtgctaatggtggaagggatgcacaagagatggtagatgtcttgccctcaaggaattcatattttagatagggtggctgggggtgggggtggggggcagtgaaactggattattttttggcaaacatgcaaacgagtgttatcacttaaatgtagtcatactagaatgacttgaccctattccaaataaaattgccactgattaaaagacacttgcaaactccacttgtggaactggcttcagaatgacagagaaaaaactagctcttcactttataggcatacttatgtataagtatggcaaggagtaagcactgtgtttgttttatacacacacacacacacacacacacacacactctctctctctctctctctgtcggtttttaaattactggccactggtgagaaaaccatcaatgtgtccaggcgcagtggctcacatctgtaatcccagcactttgggaggccgaggcagttggatcatctaaggtcaggagttcgagaccagcctggccaacatggtgaaaccccgtctctactaaaaaaaaagaaaaattagctgggcgtgggttagccgggcgtggtggcaggcgcctgtaatcccagctacccaggaggctgagggaagtgaatcgcttgaacccaggaggcagaggttccagtgagccaagatcgtgccattgcactccagcctgagtgacaagagtgaaacttcatctcaaaaaaaaaaaaaaaaaaaaaaatcaatgttctgagaataagatcatcgcagtattacgttaaatgtgtaattttccaaggtaactattacttatttagatgtgtaggttgttacatttgtttgcttttcatcagtcacatttacattaaagacaataaaatacaaagtgatataactgccaaatgtatattacagactataaactcaacagaaattcaaaagaggatgatataaacatatcacacattgaaagaggacaaagcatcttgctaggcactgacattttaaaaggttaaagtacaaaagttactttagataggaggaataaattctgctgctctagtgcataggaggattactatggttaacagtaaaagattgcatattctaaaatagctacatgagaggcttctgaaggccctcacaacaaataaatgataaggtaatgaatacaagaactacactgactggatcattatacaacataaatatgtattaaaacatcaaattggcccagcatggtggctcatgcctataatcccagcactttgggaggccaaggtgggcagatcacctgagttcgggaattcgagaccagcctgaccaacatggagaaaccccatctctactaaaaatacaaaattagccaagcatggtggtgcatgcctgtgattccagctacttgggaggctgaagcaggagaatggcttgaacccgggaggcagaggttgcggtaaaccgagatcgtgccattgcaagccagcctgggcaacaagagtgaaactccgtctcaaaaaacaaaaaaaaaaaagaaaagaaacatcgaattgtaccctaaaaatagatacaatgtgttgactaaaaaataaaatttatcaaaaaaagtttaaatgttttcccaaatatgaaaaattaataagcatttaaaaattaatcaatctcggccgggcgcggtggctcacgcctgtaatcccagcactttgggaggccaaggcgggcggatcacgaggtcaggagattgagaccatcctagctaacacggtgaaaccccgtctctactaaaaatacaaacatttagccgggcgtggtggcgggcgcctgtaatcccagctattctggaggctgaggcagaagaatggtgtgaacacgggaggcagagcttgcagtgagcagagatcgcaccacttcactccagcctgagtgacagagcgagactctgtctcaaacaaaaacaaaaacaaaaaaatcaatctcactgctaataactttaaatttaaatatgagatactactttggaccaaacaattgccaaagattttggggaaagcatgctgattagcatgcagtaaaataggcacttccataatctattaagacctttcaaatataggaaatatccttaatgaccaactacagagaggtgtttgcataaatgatgccatagctataggaaaaataagtagacattaatgattttttgtagaatttcaaaaccaaagccaattttcacaatactgaatgaaataaaattcagaatataaaattttaaacacactatgattttggttgtgttaaattatatacactcaggagaaaagactgaaatcaatagtgcaatatggttgtttctggggtgtagccaatcttttcctattctttatacatgcctgtgtttttaaaagattctacaattctctatatttctttggtattcaaaaataaaagcagacaataagaagaaatattcttcccaaaacatgtagattgaaaaaaaaaaaaggttaaggtccaattcctgcctataagatcttccaggtaaaatttcataaaacgaggttgggccacaccttgaaagatacatagaatccacatagctggggctggaactgggggctcacacctgtaatcccagcactttgggaggcagaggcaggtggatcacctgaggtcaggagttcaagaccagcctggccaacacagtgaaactaaaaacacataaaattagccagttgtggtggcaagcgcctgtaatcccacctactcgggaggctgaggtaggagaatcacttgaacccgggaggcagaggcggaggttgcagtgagatgagatcgctgcactccagcctgggctacagagcgagacgggtctcaaaaaaaaaaaaaaaaaaaaagaatccacgtagctggaaaggagtagaaagggcattccaaatgggagaaaaaactcaaagaatctaaagagggaatagttggcaaaccagaagataaatcaaattggagttacgagagcttaatccttgagctttattttaacaggccagtggttggatgaatcactaccaaataagaaataaagcaaagctatactaagctaaaggaaagtgttctcaaaaaagagtcttctgtgccacgttggtgttttttcacatccctctatctggctgcctgctggtttccatggcttagatttacccatttggaaaaacaacccctcccctgacaataccaaaatcactacctctgccatgaaattaggcaagaaatatacatactccagcctctaatttagacaataaacttgccaaaagtacggaatatatctttttttcacatagtaccaatcaacagtgtcataataggcattccaataagtaatgaattacaagttaacaatgagcaacaccttaatattgtccataaatccccaccagaactgaaattttacaagttggcaatatcaattattggtaaagatttagagttcctggccgggcgtggtggctcacacctgtaaccccagcactttgggaggccgaggcaggtggatcacctgaggtcaggacttcgaaaccagcctgtccaacatggtgtgaccctggctctactaaacacacaaaaaattagatgggcgtggtggcgggcgcctgtaatcccagctactggggagggtgagagaggagaatcacttgaacccaggaggcggaggttgcagtgagccaagatcacgccactacactccagcctggacaacaagagtgaaactccgtctcaaaaataaaaaataaaaaaataaataaagatgtagagttcctgaaatgcttatacactgctggtagaagagtaagatgctataaccactttggaaaacagttgtgcagttgcttaaaaagttaaacgtacccaataatccggcaattctactaagtatttacccaaaagaaatgaccacatatgtccacaaaaagcttgcataaaaatgttcgaacactgtacaacaaagtgtacctcttaaaatggttaaaataatacgttttatgttatatatatacttggccacagaataaacaattctgagcaagttcattcattatagttgaaaaccggaaacttaaaacatcatccatcaagtttagaagagatgagcaaattgtggtatacgcataagacgacaatgccaaagaacaaactactccaggagcatgcatgaatctcagaaacactacgttaggcacaagaagctggatccaaattactttatacgacgttcaagaccaggccaacctaatatataactgcagaagccaaaacagtggttctctttgggggatgtgcgtactgactggtaaggaagctcgaggaggctcaggggcgatgagaatgctctccctcttgatctgggtagtcagccccaatcaaaaagactattaacaataaatacagaataatggaggccaaagtttagacagcccaaggccaaccactcataaccaaaacttaagtcatcctgatttccccaaacactaaacctaaatataaaagaaacacaaatctgagttttttgtccttatcagcagataaggacaaaaataaggtttgataaggatcaaacccatcaactaacaacaaatcagcttaaacagctgtctgccttaaggatctatacatgacagccattcatgaaaaaggtcaggtcattcctcctttatgctctaaactgcaccgtaactgctataaagtaagactgtgacatttttgggtttgaggtctcccagtccatgaactctcctcttgtatgtatgagaaacacttaaaattctaacttgatctaattttatgtttgacaaaacatggggggaaaaatttacaaagctatacccttaggagttcatcataattaattatgcctcaataaaaataaaggaagaaagaaaacagaacaagtggaaaatcccagtccattatcccaattaagccccaggtttgcattttatctagccctcacgaagtactccactatcatgaggtcagagctcatcatcagaaatccccctcggagtgctgtagtgtctgtcctattcaaggcagcgttaggtctgaccacagtattttcagaacatacaactaatccatcaatttcttaagccttttaaaattcactgaacttggccgtgcgcagtggctcacacctgtcatcccagcactttgggcaggcagatcgcctgaggtcaggagttcaattccagcccagacaacacagtaaaaccctgccttactaaaaatacaaaaattagccgtgtgtaatggcacgcacctgtagtcccagctacttgggaggctgaggcgggagaatggcttgaacccaggaggcagaggttgcaatgagctgagatcgtgccactgcactccagcctgggtgacagagcaacactctgtctcaaaaataaaaaaaaaataaaataaaattcactgaatttaaaagttctacatatatttcattcctattaagacccaagacgaaccatttcatctttctttttaaaaaaggctaataatgcttcaataaatgctagttcccagtatagtgacagatacaatggagtgaggcagtctgactctggccatagttaacagatcaaggaaaaaaatcccacactcctaagattccaaagaaattttctgcaagtttccttaatgtactttaaaatccttcagaagaccatggggaaaataaatcatcctctcaaattcatattctgaagtttgaaaataaaagcagttccttttcatgtttggatatagtcactctgaacagtaaatcagctaacagacatcaacctggcataagactcttcataacctgtaattatcttctttatttccctgttgctcatctgtctcccctgctagaacatacactccataaagtcagggatcttgctgtctgttttgctagcagccatatccccagcacataaaacagttcctggcacataatgggtattaaatattttcccatcagtgatcagttcgtttagcagactgtccaaagtcaagtaactagaaagcaagacgaacaagggcagctatctgtaatcaagcagccaacttcaaatgttttcctacagaagctaagtcctaaagagtttttcttctctctcttcccctcttattaatattcctccttttcccagctatctttcctgcctctaagaacagtattctaagaattaagaaactcacttgtatcaccaactcgctgagtatccttgggctagtcaggcaatttcaatgcttatctttagtcaaaagacactggagtcattcataaggagacaacacttgcctggtgtgaagaacgagtagctgcaagacaaaatcctagccctcccagaaattagagtaagccagacagaggagggaggtaacacagcgagataaattccatggcagaagtatgcacagcatgccatgaaaatacaaacacctaatccctccaagaaggcagaggagggccaggagcggtggctcacacctgtaatcccagcactttgggaggccaaggcgggcaagatcacgaggtcaagagatcaagaccatcctggccaacactgtgaaaccccgtctctactaaaaatacaaaaaaattagctgggtgtggtggcacgcacctgtagtcccagctactcaggaggctgaggcagaagaatcgcttgaacctggaaggcggaggttgcagtgagccgagatcgcaccactgcactccagcctggcgacagagcaagacaccgtctcaaaaaaacaaaaaaaagatgaagaaaagaaggcagaggagaggagggtcactttccagaagaagcccttgcccttgagggactaataggagccacgagaaaggaacagggagatttcagatagaggcaaaagggcttactcacaggaagcagtttcacgttatgtggactgcagggtgtgagcgaacatggaaagtaaggctgaagaggtaagccggaatgatattctggtaatattacagatgtaaacctagaagaagatgagattagaggcagggagcagtttagagattattttagcaattaacaggaaaattaatggagacctcgtaagagaggagttcccaggacctcttcaacctattccaccctttgccccaggtgaccacgctcactcaaagcttcaagtattctctatccaagtatctccagcagcagcctctcctgagctctagaaccatatacccaactttctattatttatctcttcttcgaaatctcagagcctttaaactcaacgcagccgaagctaagcctatgagctcaccccagaacctagtcctcttcctgtgtttcctgtctctgcagatggcagcaccacccatccgcttgtaggagctggaaacctgggaggcacccttagtgtctcctacgtcctctccctcatccgctgttcaatccatcaccaatccctgccaggctcctcccctaaggatctcatacgtctatccactgctttcctctgtggccaccgtcagaatttgccttacccctatctcttgcctaagccagtgcaccaggttcacatcctctcctattactatttcatctcttattcccttccagtccattctcaaactgtgacaaaagtttgtttttagtgctcatcagcctgcgtcacccttttatgcccgcctactcaccccgaggagctccatcaagcccctcttcactggtgttgctcaccatatgtgcaccagcaccttatttctgaaggaatgaggactcaggttttttttttttcttttgagaccgagtctcactctgttgcccaggccagagtgcggtgggatgatattggctcactgcaaccgccgcctcccaggttcaagtgattctcctgcctcaccctcccgagtatctgggatcgcgcaccagcatgcctggctaatttttatatttttagtagaggcggcgtttcaccacattggccaggcaggtctcaaactcctgagctcaagcaatctgcctgcctcagtctcccaaagtgctgggattacaggcgtgagcaaccgcccctggccaggactcagtatttgagcaaagggaggcaagaattttaagaatttgtaaaaagtcagtattgcatggcataaagagactaaggtaaagactaaaaaagactgaacttgccactaggatatcatttagtgaccgtgtctggaacaaattcaacagagttgtgggagcagaaatcagaggacagcagattaagagggaaagggcagaaagggagtagaggtgagctggccttcttccaataacgtggatggcaaggacgatacagtctaatggctggaacaaacacaagatttagggaagggtttgtttttgttttaaagttgggagagacttgtataggagcacatgatgaagggaaagaagcaggagaggaagaggagggtatcagaacagaaagagatctgtgagcaccaacagaacaatctgccttcatttcccctgaaggaaggaacatgaatggtgatgaattcagaagagcttgcaggcagggaagcaacatgtggttcttttattttctctaagatatagagcagattcttccagctccacaagaaggtcctctcccactcactctctctttattggacaaaatatagaaccaaatactgtatgcactgtatcaaacaccaagagcgcaatgcttgatgtccactgtgagttctggaactttaccttgttccctaccagtatcagccctcttttattggtatgaagcctctaatagaaaaaagcctcccagcctggtctccagaaactggtgttaactgctccgaattttgaattcagcagagctgtgctagaaaactgcacataaggtttatactgagaatgacagctattttccattccctttactttctagtcggtagaacttaaagcctggcacagctgctattacatattccttaaacagcgaaccagatcattctcgtgggtgattttaagcattagagaagaggtcataacttttcagcaggaaaataaaacaaaggttctttctggggtcagccaatagtttatcagtggctcatcagaaaaacaatagtttaaaaggacttgcgtagttaagaatggaagaacatgggtaaagaaaaaaactgctgacattaaaatagaattttaaattaatctcttgtcgcgttaatagtactgccatataatggaagatgcatttattttctaaggggaaaatgtccagaaacttgcactcatcactcccttaactgttatcagggaagaagtgtagagtctcccagctggattatgggtagtgtaaacatctttgctaaattgcttggcagagtacatctgcatcaaaccattagagtctggaattcactctattaaaatcaaatcattagccaagaagaattaacaggaaactattttcatgcaaaacagatataaaataaaaatcaagagcaatacatgagtaattctttttcattcacaattttagatggtgcataatgcagagtattgttttagaaacgtgctgctctctaacagccatctctatacaatatagggtattgtttggatactggagcaatttaagctttttctatgtatccaaaagtccctggattaagatccaaagaaacctggcacagcaacaaagttgacttgtaacacatctcagcctttaagcaaattgtttattaatgcagcaggaaagtcgctgttcaggccctaagtaagctatgtatctccggaagtgtcccccatgttgcattctccaaaactgtgcagaattttctcctagttttccattacaccaaggatggtgggagggcttcaacaggtgatgaagaatgtgaacaaaatactaactgaaaaaaaagttcttcccaaagtatcaccaactctgtttaataaacagtggagctacagatgaatgagaagggaagctgggacatatattatctgtatataatgtctgtatatcccacagccaagagttctcacactcaaagagacgctggcttcacatggagaaaacaacctctcaggatgtgtgcactactttaaaagatctcacaaaaaagatacaaaagaaggcatacaggcatctccctatacagggtaaaaaaaaaaaaaaagctagaatttgtttagaattagacacatggtagtaaaggtataaagaaaagcaagttacaactgtggtgaactcttggggctgggagggatctgatcaaaagataatacctggaaggggcgatttactatttcttgacctggccatagtcaccgggttgttcatttctctaaccataaaatacacatttttatacacttttctgtatgtatatttcattataaaacatgttgagagatcgatccctaatacatttcttagtagagtataggcattccataaatgtttaataacagaatggataacaaaatggtactagtactaagttttctctaatcacttactagatatatttcagtttgtcatgtttacagacttctttgcaaacaaaagagtgaaatattaagagtttggaacgatcctatgcatagcaacacattaaagaggacttttaagaatagattctctatttcatttagagtaaataaacattctttcaactagtcatgattcacattgataggattaaaacattctatacataataccttgaaattaaaacaatcaacagaattaaacaacaatgcagaaaaggcaagacagcaaagcaaagtgacaaaaataattccttcgaacttacagaacatgtaacattcagaaaggaaaggagagcaaatgaagaaagcaaaatcattttcaggtcctgcttttaaaaataagcaaccacggttaggattttgttgtggagttggggggtgggaaatgacacatgagttcattaaaaaataaaagacggagagaaaactgttttggaatacaatgcagagcaagtcttaaaaaacagttgccatgagcttcaatgtgcaataataaataccactaaatagaaaccgccactgaataaacgtcagatactttgagatgacaaagatcgccagaaacattccctggtccgactgtttttatatatttgtgtacatgcgtaagtgctaaatctggatctaatttcttcctgaaaaaatccagttttctgcaacatcctcacagtcagggagaactaagctatattgagaagtttggaatctcctcacgtgccaaggaggattgctttctatctttaccgcatgttttaaaaaatcttcacagcaacacatccaggcaccctaggaatacaaggccacgcagacaatagggaacggaggaaggagggaggaagacaaacctggcctccagaaggagccaagtgtaggctccaagagataaacagccaagtacaataatctttcgagaagcgggctgagaaacaagggtgggagctggaaggaagggtataatcacaccttccttcacaaactgtaattaggagaaagacaccagccaggccagctctctcgcagagctcctgggctcacctgggcatgttttactaaccaagctcctcctagtttctttctctctctctctgtctcccccttcctccctaacccccactggcccccactccctatcctttcctgcaagtaaaaagctaaagtaaaatgactttccacagcaaaacagttacagatgttctacctcggaatacatcccagatcaagagctcgtcacttgatatgcagggctggggaccaggagagggtacgaaatggccctgcgctgtggccttttcacctacccaagcctcctaagtttcctgaaggttctgagctcattagacaaagaacaatgaagccaggactccactcaaccgctggtggttagactggtggaaaacaaaagatcacagggtctcactgaactcagcaactctccagtgtgcgtcttcccttccattccagaaaattaatttaaaagttgcccgtgatgaaacaagggataactgtgcctaaaacaatgaaccgttctaaagcttgaagtcggaataattcgctcttaagctttgagaggatcacactatgcaatgtattcctactttctcccaatataaatcacgctattaaattaaaaggagagaattcttccaccaaattacacactaatggctcttaacccataattaaagtatcgctaccagcagtgtaaagccccagccagccagggctcagacccaggtctcagccccagggatgatgtcagtgcagcgacagcgatcttgaggaaagcccgtggtctaacctgtccctgtccctgctccctggggactggctctggagctggcatccacgcaggcctcctcctctgcacaggcagacaaaaggaaagcaagcccagtgccagagcagcacgaagagcaccttccagcgaggccggtcactcagaggtgtctcacctaccctttccccaacatcacaacagcctcggaatttggaccagcaactggcttcagagcaaggagaagtgggagaggctccactgtgtgctgtaatccagggtgttatccccgtgctaggccgtgagggcacccaggacggggcatgaccctaacatcacggagctaatgaggagataagacatgaaataagcccggcgcggtggctcacacctgtaatcccagcactttggaaggccaaggcgggcggattacctgagatcaggagtttgagaccagcctggccaacatggtgaaaccctacctctaccaaaaatacaaaaattagctggtcatggtgcagggcacctactgtaatcccagctactagtgaggctgaggcaggaaaatcacttgaacccgggaggcagaggttgcagtgagtggagatggcgccactgcactctagtctgggcgacagagcaagactccgtctcaaaagaaaaaaaaaagacatgaaataattctggagaggcagcacggcatagaagattcatagaagagtcaaaactcaattcaatcctgccacaaactttctaaataaactaaatcaactctctgaaaaacagagtttccctctctgagcctcactttccttggtgaaaacaaggcaaaggtattagatgatgtctgaggccctggatagctctgcaataattagatagagaatacaaggcagtatataatcaagtattaaattatacaggagcaactacagctgccattgagagcttgcactgatttttttttgagtcagccttcattctaaaccacttcctgaaagcccactcagaccctgtgctaggattcagggatgcagcggtcaccaagacagaatgctctgccttcacgaggctttcgccagtctagtaaggtattctcaggtgttcagaggagggaaaaaatgagggctggggttggcctatgacctttgcatggagacagaggcaaaactgggcttcaagtgggtatcatctgagcattcagtggggtgatggacgcagtggttaattgctgagtacggtagtaataagccatgaggttctgaacacatagcacaagcccagttctactaatccgctcatcattagtgaagggaattagttagcttccagaagtcagccagacttcgattcttccggccctctccctaacgtctccttctcccaccccaaacctgctaattgtggttaactttttccctttattcttttcagttattcttgcagacaactatggtggagggcaggagccaggaagcagttaccaaggagggagtccacatctaagcaatatggagtcagtcaggaaggaagaccttgtatgctacaaggtaaacggctaaaaagatcgatttgcgtattaagtcacaagagaggtttaagaaagacagtacaggctgagtgcggtggctcatgcctgtaatcccagcactttgggaggctgaggtgggtggatcacctgaggtcaggagtttgaaaccagcctgcccaacatggtgaaacccatctctattaaaaatacaaaaatgggccgggcatggtggcaggcacctgtaatcccagctactcaggaggctgtggcaggagaatggcttgaacccgggaggcagaggttgcagtgagccaagatcgcgccattgcactccagcctgggggacaagagcgagacttcatcaccaaaaaaaaaaaaaaaaaaaagaccagacacatggtttattttagagtagagctatgtctcatacaactaaggaatatggtataatttagctggtaagaataattaaccatccgcatcttaatttttaaaactaaaatgtcataaaattaatttgtcccttattcttaaggggcatgaaacttgactgtgccctaaatgaaatcaaatgttgcctaccaacagtacattccattttccaaacaacttccctggaatgctggggagctgatatgtttaaaacgaatattctccaagtccaagtgttggattttaaagaaccataacctttccaacttttcctacaaaaaaatcccgtgtgtgatttatgcccatcttcaaaacaccctctggagttcagaccagatgtgtgcagtgtttacactgagaaaaccactaggacatcaacaattcactataaacaccactcaaattttgctgtgctttccttcatttcctctgtatttattctggtgttaaaataatgttaactctcataataaggaaaataggagcagatgtttaaaccaaacagacttcagcccattatcccatatagctactcaatcttcaaaatcaaagtttcttcctcccaaataccgagagagaagagcagagcagagcactctagtttcctgggtgttgcatgctacacaacaactcgacctgggctcgctgtccgtaagttggtcctcaccaatcggagacaggaaaaactaatctggtatcaatttcctaacaatcttatatttctctcttaggccattatgttttgtttttaaaatatcgtattacttgttggcaaagacaatacaacagaaattgcctcagaagtttttctttcttgttgggggaagcggggatggttaaaaaaaaaaaaaacaagaaaaacaaaaccctgactacaatgtgtgaatgtcacgggaaacaagcccagcaatggctgcttacggctttctaaagtcggctgccttttttaagtgagttcagaagcaagatgttacttaacacatcagatgcaaagaaagaaattcacgaaaattctcatagcaggaactagtaggagtaaagaaaaacaaatactctttttaaaaaacgttaaatatgagatcctcatccatagagttttaaaaaacaacgtgaatgagggttgttgttgttttttttccttgaaggggaaaaatactcttgaaagggtgagttttcaactgattaggaaacaggcctgaagtttttagattaaaaaaatacaagtgaatcaccctcccaagtttttgtaactgttttctttttcaagagaaatgtcccgtgtattattggagaaaaaatggaaactgctcctgctgaatgagaaagagaagagtcccggatgtgtgtgtggttacaacagaaaacactcttcctgccaggccgaactcccccggagatgccctcggcggcagacccagggccattgccactttttcaaatcgcacgtagaggatgtccgagggcttaagaaatagatttttctctgactgctaccagagacagttggaaatacaagacagtgggggaagcacctcgcgggcagtaggaggtaataaataacagttcggcgcggctctctctttttcagggcaggctgggggtcggggtgttgtgtaatcgctcccacagggagcggagcgcgaggaacaccccccagtgtcagcgctccccgggctgcacaggaagcgccagcgagacaaagagcccgcctgtgctcgctgacacggtgcccttccggccccacgcgggagagggacattctccgctgtttgggacgctcactcgcgagcacaaaaactcgctgtaactttggctccccctccgtgagctgcagggcgccgtggcccacagcagggtacagtagacggtgcaatccttaccagcccctcccccaaagaggctcaacttttaccggcgtcctacaagtccttcccctaaagacaatattaacggaaatcaaaaatacatacattttaaagagttaaaaatgtgaggcgcgagtacgttgcaagcaacgagcaaactttgaagggtttctacttcactgcctccccgtccagccccctccaccgccccccgcagcctgagatccgaacacactcggtgccgaaccgaacctaagaaacgccggcctttcaagtgccctacaccccggaggaggacagcgggcgcttagaaggcaggcacccagcacactgaggaggagtggccgggacgagcaacgggcagtaattctacaacgggacatctaccttcgtagcacagaatgccgatattgttgttcatcttgtccaagtactgatagttcaacaggtccatcttcataaatagcatttattgggctagcaaagaaaaccagctctttgcttttgccccaaaagagttaagtttcaaaaatcaattgttgctgagtagctcctggctcttcaacttcacaaaggcagaggcccagcctcagactatcaaaacaaagtatgcaaaagttaaaaaaaaaaaaatcaggcacaaaaaaatcgagctcacacgaaacccttcaagggcttactggtagacggtgtatgtactgtatccccgatcgagtatgaaaacagcgtttcagaagtccttacaagtccttcctggaaatggaaaagagtgaaaaagagaaacgcgcagcccgtttcctaggacaaagcggcgccggcccctctcacagcccgctgcaagccggcagcgctgacatgagggctatgcttggcatgactcctatgccgccgcttcctcttcccgcaggaggccgagcatgctcactgcgccgcgctgccgaggcagggagggcttctgcacaggatcagcctctcaatgtagcaagtgttggaaagaaagagaaaggggagggggagagactctagagacggggccttggcagagtggctcttgacaggaagcagccaagccgctgcaaaaccgtaggaggaaaaaagaaaacccaggaagtttctttttcaggagctaagtacaaagtaaaaaatccatcatggaagcaaactcccatggaatgcaactttcgtgaaacttcatgttggggtttcggaaacccaaagtgctagtgatgcataagccatatatatatatatagtgtctttgtttcttttaaagattgttttataatatccatttacactttaactggatatttaaatttctgatgttaatgttacatatagcttcttccataatccccataacaactgagatggacagggcaaggagggtatcaccctttcacagcagaggaaacaggttcagatggattaaatgactggcccacagcccccaaaatagttgacagaactacttttaaagtgttttttcccacctaatgttataattttatttaaaaaaacgagggggccgggtgtagtggctcacacctgtaatcctagtcgaagcaggcggatcacttgaggtcaagagttcaagaccagcctggccagcatggtgaaaccccatctctactaaaaatacataaattagcctggtgtggtagcgcacgcctgtagtcccagctactcaggaggctgaggtgggagaattgcttgaacctgagaggaggaggatgcagtgagccaagatcgtgacactgcactccagcctgggcaacagagtgagactttgtctcaaaaaaaaaaaaaaaaaagaaaagaaaaaaaggagacaaggagaggagaagagatggaagagtgtttaagcaaatagggctataatatcaaaaattaaaagtgtacttgaaattatagagggaaagggtaaaattattttcatttggcatgtatgtcacccacctgtgtgtaagaagctagtggcatgcagctgtactatttgctattggaagaacttggggcttaaactttgattacccagtgcctagcacaaccaagttcaggtgcccaaaaactgtttactgaacgagtgaaccactgaatgttcagttttcagcacatcaagaacgtgttaacaaaatagaaaaaaaaaaaacaaaaactaaacatttgaattactattctaaaaatatatttttaatattccaaaataatatttgaataaataatttgaaggagttgtatgttaaaaatccagcaataggccaggcgcggtggctcacgcctgtaatcccagcactttgggaggccgaggcgggtggatcatgaggtcaggagatcgagaccatcctggctaacacggtgaaaccccgtctctactaaaaatacagaaaattagccgggcgcggtggcgggcgcctgtagtcccagctactcgggaggctgaggcaggagaatggcgtgaacccgggaagcggagcttgcagtgagccaagattgcgccactgcagtctgcagtccgcagtccggcctgggcgacagagcgagactccgtctcaaaaaaaaaaaaaaatccagcaatagttgcattgggtttattaggcacactcatggcaaggtgttctaatgaaatcttacttgggagtccggatgcggtggctcacgcgtgtaatcccagcactctgggagactgagacgggcggatcacttgaggtcaggagtttgagaacagtctggccaacatggtgaaaccctgtctctactaaaaatacaaaaattagccgggcatagtggcatgtgtctgtaatcccagctactagggaggctgaggcaggagaattgtttgaacacgggaggcagaggctgcagtgagccaagattgtgccactgcactccagcctgggtgacagaacaagactccgtctcaaaaaacaaaacaaaacaaaaaaactatatgacatctaaatactaaatactgttgccgtcattgctgcaacagtaatcactggggtgacatcaggggaagtaagtaataggggaatcaagatttcacaagctttcatttataagaatatttattgacactatattacatgtaataagctatagtgaaagatatgtatcctatcaattgtaattaaaatacttaatggtatttggtggggagggttgaagaaaactcaaaactcgtaacatccagtatacatgagatcattgcactgaaaacaaacaatatcaggtatcagatttaaatttaactgatagttttggagtactcttactgtgctacgtttttacataaattctcaatcagaaaactttatccatcattgtcccacatggaagagaggtggctgcacattagaaccaggggggagcttttaaaaatcttgctgctgaggttgcatccccaactcatctgaggtgggaaccagcagcagtagcttctaaagtcccaggtgattccaatatgcagtcaaggttgagaaccattgctttcatctagggaggaaaaaaaaaaaaaccctgccttaagatatttcattttattcacttattttgacatgaagaatttttttaatagtaatttaagcaaatgattcaaacaataccattgtagaaaatgaataaaatatttggtaacgtcccttaagggactcagcatcacttagaacagcagttctcagcctccgggtggcaaccattttcgtggacaccgtctcacaggtctaccttgactattgtaacattcccagccacagccaccacgtctttcccgctgatccgggaggctagcacggtgctacccaagtgtgatccagaggggttcgagcaccaggtgttcctagtccccaaaagctagatacagaaacggagaatgaacatttaaaacttttatagcaattcgatagactaattttatgtctctcaaatcttaatattaaagaaatttgagggctgtagttttcgtatttctagttatagggctgcattacattttataaactatcagtctgcaacaaagtcttggggaaaaatgaaacaaacctggtttcacagagaagcttgtgctccagaggggccagctacaacagcccgcctctgcaggctgggagcgcctcctggaccggctctaggcctttccatcccagctcctgacaactttcaccttagtttcaagcacactggatgacctgcagtgagttattccacaaagcacatcagtatgcttctcggtgtgcaggacgtctcttctttcccaacctgtctactcagcaaacatccactcttccttgagacttgtcagaaagcccctcttgtcctgtgaaatctccctacgatcccatcctaccatctcctcacaccctacgccaagctatccttttacagggtaagtagtccttatccaaaatacttggaccagaagtgttttggatttcggaccttcttggattttggaatagttgcattatacttaccagttgagcatctctaattttaaagtctgaaatctgaaatgctccaatatgagcattttcacctgaatgttgtgtcagcactcaacactgttcagattttggagcatttttcatttcagatttttggattaggacgctcaacccataccttatatgtgcttctttcctagcctagatcttcggagcaaggactatgccttcctcaccttttcgaggtcagtctggcagaagtctggcagaagcctggcgcatggtaggccatcaataaataccagctgaataaaatcagtaaacatctaaacggcagattcttcatttccccatccctacttccagcacactctggattatcttactcgatgtcattaggtggctgtcaacatctcttggagaccacaggtccttgcctttaagaaacaccatgtagattctgattgtacttcagggtacaatcagctcatccataaaaaaaaaaaaatactagaaaatatcaatccttctcagattcattcataggataatatattcataattaaagtagcaacaggatagttttgtagggaattggaaagatgggtctaaattttatccacacacacaaatgagatgggaaaagctagttctttttctacgaatgaataagtttgatctatcaaatatttaaaacataaagcaaagaatatattttggagtgttactgggtagagactaggtaggaccagacagatactgtggatataggaatcagaaatccaggccaatggggaagaagtggattacaaaacaaacattactgagaaaagaatccagatagcactttgccttatactgtacatcaaaataaatcccaaatgttttaaagattatttagatgcttttaaagtaaggtttttgctgcaaaaacttacaaaactataaggatatgttcagactatctgatgtggaataggaaaacatttgctaagccagaaataaaatttttaatcaaagacagaagccaccaaggaagatgtagaatttgattgagaatacagattttatgcttttatacatctaaaaacaccaaaaccaagtaaaggcaaaatacaaaactgaagaatatatttgtgtcatatattacagtgaaggataaatgttcttggtattcaaagaacatttaaaaatagaaagaacaaaggaaaaaattgaaaaaccacttgatctgaataacattttttaagagcatgagaaacaaatggccaacacatttttgaaaaactattcaaccttactaataatcaaagaaatataaattttaagtgattttccagctaccaatttaacaaaaagactttttcaatcttatttcttgctggtgaaacaggatgccattggaatctttgctcactgctaatgcagtataaacagataacgcctgtgtataaagcaggttggcacacactagactgttttatgaaaaatgtccatgcctttgtccttgccttggactctacttctagacttctgtcttaagaaaataagatttgaagagtttcataaagatgcttatcatacagctatgtgtaaaatgaaaacctgaaaacctaaagtccaaataaaaggatgcattaaaaccgtggcttatcgatgacagactattacgcagccattacaacaccttcaataatctataatgacatgaggaaatgctatgctatatactgtgtgacagtactacatttgttaactgaaaacaataaaaatcggatataaaactaaaacacacattattcaccaactgtgctaatgtatttatgaaaacatacatatatatataggaaaaagtatacattaaaaagactggaaagtattccaaaatgttaatagtgcccatctttgaatggtgggcattttttccattttcctgaatttctaactagcctacaaatagtttattcttcctataatgaagatgcggataaggaaagttcttgatttttaaaaagcagcaacacaatgaaataatattccctggtgagacataagcaatggatatgtatatcttattatagcttacatatctcatgatatctccttttgatttgggtttaacaacttaaaaataataagaatccaaacatttctttagaactttggaacattcaaagatgtttaagatggggtatctgtctcaaagagcaaaattgacagagacagctctacacttgcagagcttatagacatgtgtacgtgctttttatcttctactgcttactaattatgtcatatgtcagtaccaattcccccaaactagaccataagcttctagagggaaggaaagctaagcctcagtccttagagtaaaactcccccacagcacacaagtgctctatttggtttggtttggtttggtttggtttggtttggtttggtttggtttggtttggtttttttgaaacagggtctccctctattgcccaggctagagtgcagtggctcaatcacagctcactgcagccttgacttcccaggctcaagtgatccttccaactcagcaggaccacaggtgcatgccaccgtgtctggctaacttttttttttaatcattttttgtagagacaggttctcactgtgttacccaggctggtcttgaactcctggccttaagccatccacccgcctcggtctcccaaagtgctgggattactggcatgagccaccacgcctggcccaataagtgctttataaatgttaattatggttgtgcctcagcatctttgtggaataatggcaatatgacgatagaagaaagcccaggctaattactaggctgatctgtttaattagctagaggtttgactaccactttagaatagatcaccaaaactgcgagctgtgtaataaaagccaaatactcttctatttaatatcagcctgtggaaagaaaagccaaatgatcaaaatcactccccagacatttatttaaaataaaatgctttcatttgagcacttgaagagaggggaaagttttaatgttaagtctaacataacatctccaaataccacattagaaaatatgagtaaccctactgcgctatctgtttcccctactgggttccgctgtgctcttcctcccagggtttcaagtaagctggatatttagttaatactttcattttaaagtgctttttttctcttcttgctacacatagaaaacacacacacacacacacacacacacagacacacactttaacctgatgtaaataatattcaaaacagaccttactaataacaagaaaataagtttgactattccttgagctaaagcatcagttaaacaataagttggaggtgcaaaactgtcatgtttcagaggatctctaggtccgtcgcaatttaccagcacattcctcagtgtactaagaacagtaccaatgatgatgatgatggtggtgtttgtaaaacactacactggtcaacacatttttgcttcgtaatctacttaatttaattactaagacaaggttgtaagaaggaaagcatagaaaagggtttaagggaccaggcgcggtggctcacgcctgtaatcccagcactttgggagggcgggtggatcacctgaggtcaggagttcgggaccagcctgactaacatattgaaaacccatctctcctaaatacaaaaaaattagccaagtgtggtggcaggtgcctataatcccagctacttgggaggctgaggcaggagaactgcttgaacccaggaggcggaggttgtattgagccaagattgtaccattgcactccagcctaagcgatagagtgagactcaaaaaaaaaaaaagaaagaaagaaaaagaaagaaaagggtttaaggtaaaacctagcattgagtaataaaaaaggaagacttaagaaaccaaactttcttttcttttaaacattgtttagaatgcaaattccttaaaggcctagctgaattaccaaccccccgcccccaccaagaaccattagctaggattaatctcttcatcctgcattattttaggtttattctatacttcattctaaaacaaagcagactataagatagtttctgtgtctgtcccctaccatattataaagactgctttgtacacggtaggtcaacaactaagctgctgagttaaaggagaaaccaaaacaaaacaaacttcaaatgccttaaatatcaatgacgtacagtaagtaccagggagtagctgatttaaaaaaaaaaaaaatcagcgacataaaccaaatatctaataagctccctttgttgttactttcttttaagaattcctaaatatatcataaaatagtgattatttatacaacttggggctgctcaaggatgatttttttaaaaggacagtattttgtggaatttttcacaaaagcaaatatcattaaactatgtcttagattttattatttacaaaatactaccatttgtaagttaaaacacactcaacttctattaagtagcgactgatcattctctgtaatataagattttaacacaaatctatggacttttcaaaaactttaaatgggtcttcagatcatatttaaattttcaatacaacaccaccctctaggggtgaactttaaattacaaagaccattttgaaaaagcaaactgcagaattcgtgctattcttgcctgatgtgcattatatttcaaatacaaaaataaaccttattttatttaatattaaaattcatagaaaatatcttttaacaaatagtttaattcttactaaactctgcaaaagttaaaacaaaatacaaaatcaattaaattgatgccaagtgattaaataggaaatgtgctttcacataaatttaaccttaataatcctaaaaagtgcagactgggaatggtgttttttgtttttttgtttttttgacatggagtctaactctgttgcccaggctggagtgcagtggcgcgatgtctgctcactggcaacttctgccccccgggttcaagcgattctcctgcctcagcctccaaagtagctgggataacaggcacgtgccaccacgcccgggtaatttttgtatttttattagagatggggtttcaccatgttggacaggttggtctcgaactcctgacctcaagtgatccgcccatctcagcctcccaaagtactgggactacaggctaaggaatggtgttttaaataaatcagaataaatcagtgcgagggaagggaatttaattagattagcatccccaagaaaagagaaatctcttgcaaaacactttaacttgttagttttacaactactgtcttacatgtttgacaatacaaatattttcttgcatgtttacatacatgattattttagtgattttcgctactacaaccaatttaggttcagtaagtcccattcaaagaacattcacaattaaaacgctattctgatattcactttgtaccaagtcataattactcatagatgtattcctgcaagattgactagaactgacttccatggtaaaaatagaagaactggagaaaatgtcccaaatattcaacaactgaagggctaagttcgctgctagccccaatgtgtgacccaacttcatttcacaggtcagtctgcctgcacagtgcttcattcattatgcagcacgctaagcacctccacagtcatccttccaaccagttagggtgccgtccaggaaagagaaatcatggctgttatttatatagggagaattttaatgtatcccacctccacctattccttcttccagtaactacccccatagggtaacttactatcctaacctttaagaacgtagatcagttgtataacactttatagaaagagaatcgtatgatgctagctactcttgtggctggattccttcactccacatattttatgagtggtagcattatttttatgtgcagttgcatagcattcatttgcattgctgtctagtactccattactccaatatatcgcagatccttcattctaccactgatgggcatttaggtagtttctacctgggggttattataaatagtgctgctatgaatattctagtgtgtgtctcttatcagcctcggaatgcatttctgtcgcacatgtactcagaagcagatacgcagaaagtgtatgttcagcttaagtaaatattgccaaatagttttccacagcagttgtacccgtttatactcctaccagcagggtatgagatttcaagttgctccccatccttgccaacagttttccaactctttcattcctgttattctggtaggtctggagcagccacactacgactttacttcgcacttctctgatggacagtaagaactctgtgacacttgtagcaggcagagggatagaattcacccgagacaacacagagggaagggccccggccagaggctctcaaccaaggagattctgccctcctcaggagacatctggcaatgtctggttatttcaaatttgggggtgttgttaacatctagtggttaggagccagggatgctgccaaacatcctacaatgcataggacaccccccaccaccaccaccacaacaaagcattatttggcaaaagtgacaataatgccacaaatcaagaaacccaaatcaagcaaatcattattgggcattttctccttagccaaatcatcattctctgatacagcacaagaggtcaatgtcctattgtcttaaaatgttatttttcctagagttgaggggatagaaagacaacaaaggatactaagtgccacactccatggcacagtgcatatcttctgcatatcctgtttctttctcagttctcgcgacaatgcggagatgaggaaacagataccaagcaggctccttggctcctctaaactcacgcaaagagcagcagagctgggaccagaagctgtgattttccactgcacccagggtcttacttttaactaaaaataaggggagtttttagagtccacaattcctgttaacttgcaaggcatgaattttaccttattagctttgcaaaaggcaggcaaataaaacgaggtatgagaaaaagatcatttgcaatgttaagattattaacctgcacctgtaagtatcttaaaatatttcaacaaatccaccttcctcatcacacggtgatctctttgaaatgaaacccataccatatttttctttgtctatgcccaatacctgtaagagcaggcattcaacagttaacatgtcctggattaattactggcctgaaaccccagtgagagaagacagaatctttataaaacaagcaggtggtttagattttatttcatcaccaacacaactatatttagtaacattaactagaataaacggtttttgttgaaaaatattcaattaagtcaaataatggccaataccacaaaattctttttgaaatgcaaacaattcaatttttccaaggatgagtttgccagcattaccttatcctcctgtggatcttctatttgaggcttctatttgtgaggccattggcattattagggccaacagaaatccacccactattagagcagttttgaaccgtggccatacattacaatcacccaggaggttttgaaagccatgggtgtccaggaggataatttggtaaatctgcagtagatgaattttgaatttacacccaggaaataactacacttagcagtatcgtttgaaaatagctacccacgtaatttttgcaagctcccctccccttaggggtcaggaccactaccctggagattctgaactgaactgaggagggcacctggctgcttttcatacccaccagagttcaacatcccaatgagttagttgctcgtgggcaggactagggggcgacgtgagcccacctaacaaacagcctggcttccttcccacagggatggcaccacctggtcatttgtatttaaacaattcccatctgctttacacagaaggggcaaaccaaacccaccacccccattctcagcctatcttcttaaattatcaacacccagtagctggaataggacttgaaatggataaacctaccaacacttgactgcagtgagcccagaaatggacaaggcaggatttcctgtttaccccacatagggtggggagtgcggggactaaggggtcctaagaagagacagcatttgccggaggaaacagtggggtttccagtttgtgtctggttccggctggtggcggggggtttctagtgactcgtctcactgcataggagcctgccctcagaggacgcaggcaggtgtcatttcaggcctgtgtactcctctgatgaacggccatctccctcccattcacatccgtgctgttttgccttatcattgtttccccagcacctaacacaaagcctgacactggtgggtgaccactaaacatttcttgaaagaacaaatgggaagggagagctccagaatctaagctgggaacagaggaaagcgagaagcctaaaagaaggagcgaactgaagaatgaaggaagtcaggagggagcgcaggtgcacagctttgtgatgctctgcgtggttacaataaagagatgatcaaagtatgatttcctgaagcacatggtctattgccatacaaaggctcatgatccctaaggaggggagaataatgagaacaggcctaccagggagcacacacgacagacgaggtccattcaccacacagggagtgcttcccaaatattaaagtccagttgctcacttaggatggaagcaggcctctgtggaaagtgacatctgattaagtttgaggtgtgccttttatatgagtggttctctccagagatggtgtccaacacagggagggatccacggtgacatataaggcccccggaggctagaggagttcccaggggtgctggtgttggcagggcctttaggctggaaggctaacaggctaggagcacctgagctggggatctttgcagaaggggctggcagagctcagcctgctgtggctaagccctcaacgtatctgtcaaactctagagctgagatgtccactggggtgcagtagctgaggtcagtaactcctatagggtctgacagtgtgtggtgtcgcattctcgaggggagggagagcacaccccaagttctcaccacagcaaagcaggccactcgcatagcaagccaggtaagcactgggagtcacttcaaagctccataccatgtgagaaccagggatggctttgagaaagaactaggtttctagccaggctctgaggactagccacaatccaggctctcagagaagcaagatgactgtgaccccagcaacaacgaagcacggccctggtcaggcattcagatgccaggaaagagaagagggggtctggaaaggaaggactgacccgaggaggagaggactgtcctaagagcgtctgcagggaggctgggagtaggcagcaaggaggtaaggaaggccagcctggagctgagagcagtgacgggcctcccaagctgagccctctgtactcttcacactgctttctagcaaaaagagcactggatacagagtcagaaaaatccagttcccaggccataacctttgctagccatgcaatcttcatcaagtgattccacctctctaagcttggatgtccatctcggcagcctctgtgttgtctgcccgagccctaaaatccaaggactccgatcattcctcttttccctctccactcttccccacccaaccacaggccgccattcactgcaatctcaagacagaatgtcatgttttatagaatacacgacggtaactggtatttctaggagggttggctcctgggtttatgctgtttttcttacaaatgtggcaagcaaatgagagcttcacctcccaagacaaaaaaataaaaaagagacattttaatcttaacaatgggcatgaagaatactgtttggctcattttcctgctggtatgaattaacaataacaattacagggaacaatggtgagaggatcttaactaacccaaagttctctgtgtctctggagagaacactgaggcaaaacagctgctaactaggaggaatctggctttctcttccgtaaaatgaagagatctaaaactcctggctgtcactagttctaggtgagtctggctactagagggttaaggagactaaccctttcacccataaaagtttcaggtgtaatcctattactttggaatggctagcagtgttctacgaaactattcaaggattaaggttagagaatgcctgtgccctatggtacaggctgccataaagaaaattatgatcctagatgcagtgatgccaatttacatggtatctacataaatgattcttccagctccctcttctccattttctcagtaaaacaagttttttgttagtttttcttcttgagacagggtcttgctctgttgcccaggctgtagtgcagtggtatgaacccagctcactgcagcctcaacctccgggactttaaaaaaggcgatcctccaacctctcagtctccggagcagctgatactacaaatgtgcaccaccacacctggctaatttttgtatttttttgtagagattgtgtctggccacgttgcccaggctggactggaactcctgggctcaagcgacccacctgccttggcctcccaaagtgctgggattacagacgtgagccaccatgcccggctaaaacaagtttttaagagggagagaaatgagcaaatacagcattgcacctgcacgttcaggactgtctactccccaaagcaataatcaaactaccatattttatttatagctgctctcaaggcacaactgcttccaaagtacaagctagaacatttctagtttggtctggaaccacaaaggaaaggtacaccaacatgctgtaccttggaaagctgacctgtaaaacggaagccttcttcgtaatatttaaccaaacacagggcctgacaccttccagtcctcttctgacagatcactgcaatatgtttgctgttttaatatcatgattaattaaagagccagctgacaattttacaaactaggaaggacacagaggaaacagaatacgcgaactattcctggatctttccttttatccagccggcatgtggcacgctattcttcatgagtgagaaaatccatgccctaaattctcactcataaatgcatatttagttaatattgaacaaaaagaaaatagtccaaataatttgtcagatatgcacttataaaacgcactgagtcaatgaatgcaaaaatattttgaagagccaaaaagtgctatcagctgctaatagaagacactagacaaagtacagcatctagaattgtttttattgagagaagaattttgctgagcccagaagcagaaacatccaacataggtacctaacaccacacacatacagcacctccaggcgtcaggcacaactatcctgcccagagtcatgatacaggtgaacacctagaagttaaacccaatatatatacaatttccatgcctctaagaattatttacttgtgtctgggaccctagacatacagcaagcaaggcattcaaacaacatgaatagagtgccacgttaacgaagatctcactccactggcccagaagggattgggatccaaagatgagtaagacacagtccctgtccttgaagagtatatcacagagggcagaacataagacctacaaacaaacaatagaaggcagagggaggacaaatcctattttctttttttttttctgttttcttttctttttctttttcttttttttttttttttttttttgagacagagttttgctcttattgcccaggctggagtgcaatggtgtgatctcggctcaccgcaacctccacctcccgggttcaagcaattctcctgcctcagcctcccgagtagctgggattagaggcatgcaccaccacgcccagctaattttgtatttttcagtagagacggggtttctccatgttggtcaggctggttcttgaactcctgaccttgggtgatcccccccggctcggcctcccaaagtgctggaactacaggcgtgagccaccacgcccagcttcaaatcctattttgaagggacttggggatttcataaaaaaagtggcattggcatgggcccttaaaagaacaagatctcaaagcaggtttgaggaatgcggcattctaaacacagtacttcagtagacacaaacaaagtatttgctataacccattgattattgcatgagcagattaagtgaattttaactgattactaagaacaagagttccgtaaactgtaaaactatttaaaatttcccatcttggccgggcgcggtggctcacgcctataatcccagcactttgggaggccgagactagtggatcatgaggtcaggagattgagacatcctggctaacacggtgaaaccctgtctctactaaaaaatataaagaattagccgggcgtggtggtgggcacctgtagtcccagctactcaggaggctgaggcaggagaatggtgtgaacccgggaggcggagcttgcagtgagtggagatcgcgccactgcactccagcctgggcgacagagcgagactccatctcaaaaaaaaaaaaaaaatttcccatcctgccagccagcagttagctagaagcaggttctgatcttggttcggccacagactggctgcgtgagtttaggcgtgttacagaatctctctgatctacttctgcatctttgaaaaatttggataatgatacagcctgaccattctcctttgatcataccacttttctcatggcatttaatatggcctactataattacacatggctttatctcccctgtagaccaaaccaagagctcctgagggcaaaggcctttgcttatttactctgaaacgcagcccagtgctagctgtgctagcagacacattgtcaatgccagcttctaccctttctgttggattcccacttgctatgaaaatcctttcctttgttctacaaagtacactgttcttcaaatcatgaagtaacccagtttcaaaattttagttttactttgtaagtttcagcatatctctatcccagtatggtggggtttcttgttgttgttgtttttgttttgttttgtttttaatattgtaaatgttataggtttcaaagattatctatttgggaacttgggcataaactcaacatatatacttctcatgcttccaagtactggaagcatgtggaatctgagtggaaaaatcatttaaatttagctttaaaaattaaaaaattaaataacgttgggatccaaaggaaagactcttaaactttatgttaactgaactttcatttcggccttgtttccaatagattgagaaaaagattgaataccaaacagcaacaaaagcagcccatgatgcatttcagtgtcatcagggtggctgtggggctgaattgtaggattatgatagccaaaattctttacaaaactgaacactaccctgctagttgatcgattcaaacacaaagtgtgagcagcagtcaaaattccttctgtcctagagagaagaaatgccctcaggatggagggctggaaagaaagctctctgaggcggctgactgcaatgaaggttgccagtgccccccgactccaccccagctcctcccagtcacaaccactcagcaggctggtaacgcagaaagaacgatccacattgaaaactgagtcatcatgagaaaggctccatcacagacaatgcaaataaggtacaggacaaaggaaggaaaggaatattgccaagaaaaggtcaatgaagacacaccagacagccagagagattatgctggaaagaattggaaagttatgaaccaacatttttccttttatttatttatttatttatttatttatctatttatttatttatttatttttgagaggaagtcttattctattgcccaggctggagtgcagtggcatgatcctggctcactgcaacctttgcctcctgggttcaagcgattctcctgcctcagcctcctggagtagctgggactacaggtgtccaccaccacgcccagctaatttttgtgtttttagtagagatggggttttgccgtgttggccatgctggtctccaatccctgacctcaggtgatctgcccgcctcggcttcccaaagtgctgagattacaggtgtgagccactgcgcccagcctgaaccaatatttctctatgagactttaaaaaataggcatagcctccctgaaacaggaactcaaataagaaacaggacaacaaggggagattaaaagatagcaaagttcagggaagaaatgaagttcaagaagagtgaggcaatcccggaaacggatgccgcactaaacagcaataaaggaagtggagacactgatggaaacacaaccaaatatatggaggacacattccagaaaatcccagtgattggctcaagaaggagcacatgactcacagacattagctgcagactttctggaacaaagcccaagaaagctatcagaagaaacattctccctggctaacattatgtcgccagctgctaccacggtggaagtcagcccaaagacagggccacataacaagaaaaccccaagagaaatgaaggcagaacctgagaacaccatgatcctctgagtcaaactgcacccgaagcccaccagaccttcagacttttcagctatgtgaatcactaaattccttttattttaaaaaattcattagaataagttttccattactggcaattgaaagcttcttgatacacttaagaacagctgaaatgaaaaaagcaaaatgttcgtaattctaaaacaatacattgggaaggcaaacaactgaaaaattattcaaaacaggagaatgtagtaaggtggcttattataaaatggatttatcaaaatccaatatgaaaacaacattttatgtgcagtaggcacaatccaatggccaactcaaaatatactcccaattcccttctcccactgcctccactagagggactgagaaagctgaatgctctctattccacaatttctcctaactaggagtgccatgtaatacggatctggccaatgagacaggaacagaagtctgctttgagcttctgggaaagtttttgcttttcttaattaaaaaaggccagatatggctcatgatatctcattttctctctccttgtcttactgcctggaatgcaaatgtgatgcctggagataaggcagccattttgtgactgtgacatgaaaagcaggagaaggctacaaaataaacaacagtgattacctcagaaaaactaggaacttgagatgggagggactttcttcacaaaccgagttttctttttttaaaaaacacattttataacataaactaggaaataaaattattttggaaatataaaggaaagattattagggtttgcttgcagtagttaggaggtttctgagaggggaagagtaaaagttgggaaagcgaggcagcagagtaaaaggtgatcaagctatgaaaacaacatgagccaggagtttactgaagcagagtttttcaaagtagaaagcagtagaatatacgagtgaaaagataaagggggctggaggatgaggataagccagacagaaatcagacctgactctacagtgatggacactcctgaatagtccctagaggttcctttttagcagggccggggaagtggtacaataaaaacaaagtttgaagtccaggatacagaataagttggcgtttaaagctaaagaaaacagaagtgaaaatcagaacaaattcatccaattcagttctcaagatttcaagattaaaactgcaacatttaactgtaagaatcctaggcaaggcgcggtggctcacgcctgcgataccagcacttagggaggccgaggcaggcaaatcacctgaggtcaggagtttgaaccagcctggccaacatggcaaaaccttgtctctactaaaaatacaaaaattagccaggcgtggtggtgggcacctgtaatcccagctacttgggaggctgaggcgggagaatagcttgaacctggaacacagtggttgcagtaagccgagatcatgccactgcactccagcctgggtgacagagcaaggctccacctcaaaataaaaaagtaaaataaaataaagaaagaattttattgctgtacacactgaagggtttggacggttctgttattacatactttctttacatatccttgtttctgaagtaagcaaaacaatggaatttaatttctctatgctgtaagaaaacacatttgtcatttctttttacatttcattaaaagtaatggcaaaaaacacaattactgttgcaccaacctaatacaatgtaatgtaaaaagaaatgtaggctgggcgcagtggctcacagctgtaaccccagcattttgggagtccaaggcgggaggatcacctgaggtaaggagttccagaccagcctggccaaatctctactaaaaacacaaaaattagccgggcatgctggtgcacacctataattccagctacttgggaggctgaggcaggagaatagcttgaacccgggaggcggaggttgcagtgagcccagatcgcaccactgcactccagcctgggcgacagatcaagagtccgtctcaaaaagagaaaaataaaaaagaaatgcagctgcaaatagaacagaagctggacacagactggtccctggaaggaaggcaaccagagtccagtgcactacttttggatagggaggtaatcaagagagcactctatggggagtccaaagacctggactctggtttcaagtctacctctagctcccatgtggccctgggcaatcacctctgctttctgaagctcagcatgctcgtctgtaaaataagggaattggaccaaaaattcgctacagtccttttcaattctaaattctgtgaatagtttacttcagccttggagctggcagggacggtggctgagagaagaatctggggaccagggctggagaatcagggctgaataacgtgggactgtgcagtaaggggtcacccatgaaacctggagtgtgtatccatctaataacaccatttacattcttgaatattccggaagtcctacacttaggaagaggtactaccaaattccctatttgccctgaatatggggacacataagagctatagtaactataaaacatgttttatagatcttttttaaaattgtgtaattagtgccttaatatgtatgacaaagagtaaaaattcatccagcacgccatgatcttcagccaattcataccagtaactagtgatcaggcatcccaattttcttttctctatttttttttttgagataaggtctggctctatcacccaggctggagtgcagcagcaactactagagattgtcttaaatgtctctagttaatttctaaatcattttgattaattccaaaataaagttccaaatgctgttcaccaaaatgaaagcaatttgaatatttttcttttttttttttttttttttttttttttttgagacggagtctcgctctgtcacccaggctgcagtgcagtggcgccatctcggctcactgcaagctccgcctcctgggttcacgccattctcctgcctcagcctcccgagtagctgggactacaggcgcctgccaccacgcctggctaattttttgtatttttagtagagacggggtttcaccgtgttagccaggatggtctcgatctcctgacctcgtgatccgccagcctcggcctcccaaagtgctgggattacaggcctgagccaccgcgcccggccaaacatcttaatccactctaaaaagtcccccatattgaaatcccaacatgccttcatacacctgcagcttcaccaaagcaacttcacactgtgctgccagccacagcctgaggctgagtgactccggagtggcagaaagagcctgctgagcagctgtgggggaagagggcatccagcattgctccctgcaaaggaagccaagtcctgaccatgcctgaaggcgcctgacaaagtctccacagaacaccacggccaggagaggctgtgacagcactcattcattcagcatatatttactgatcacctcccaggtgccaggcactgtgctaggcactggagattccacagtcaacaaaatgagacaaaactccctcttttcgtgagctgcacattctagtgtatgtgaaagacaaatgagagaaatcaaaataaagcaggaaagtgcaagcaaggcacaggtaggggcaagagacaaggaaggctgctctgagaaggtgcctctgagtgacgacaggaagggaggacacaatccccgaggattagaaagttcattctgggccgggcgcggtggctcacgcctgtaatcccaacactttgggaggccgaggcgggcggatcacgaggtcaggagatcgagaccatcctggctaacacagtgaaaccccgtctctactaaaaatacaaaaaaaattagccaggcatggtagtgggcgcctgtagtcccagctacttgggaggctgaggcaggagagtggcgtgaacccgggaggcggagcttgcagtgagccgagatgtgccgctgcactccagcctgggtgagagcgagactgcgcctcaaaaaaaaaaaaaaaaagaaagttcattctgtgctgcgggaaagcacatgcaaaggccccgaggcaggaggaggccagcgtgacttacaggtcatggaagagccacagttcttatctctgcatgagatgggaagctcctggagggcttccgaacagagcatggccagaatctgagttcccattttaaaggcccactccagcaccagcgtggagaacagagagaaaggagatggagttagaaacgggaaagcagctatctgtggactagggtgctagtcacagtgatggcaaaaagtgatcagatgtgagatatatctgaaggcagaacaaacagaatttgctagcagacagtttgagatgtgagagaaacagaatcgaggatgactgtaaactttctgggctccataaaagacaaatgcatatctggacataattactactcacactggacacaggcttggaaatccagagccaaagacattctgtaaacaccaaaagggcatctctaaggacctgaaaacctacaggcttctaaggctccttaaaactccaaccttacaaagaaattcactgtaataagtagttacttacaaaacatgaatgctacaaccctcctctgtgctcccctccactccggtgtgcatgcgctctcctatctgcggcgcctgctctcaggttccccctctccagcctccttcctgactccgcttcctcattccacacaccttgatgcagatcttctccaaagatctagcctcatttgccctttcttctatctctacagtctttcactcagcaatctcaatcacttccagcaaccatctcttcaaagaaaaagaccccataaatttctatctctggcctctttgcaccacaggttgagaattcaaattacatccttgatgctagtagtgcagatgcctgccgcatctcaaactcacaaagccctacactgagactccaatcttcccatctctttggctaaagccaggggcttatgactgagtgacaggttacagagcttgggcttcattccataggttaacatggtgcaaaatacgattgctgagctttgcaatgatctgtccttatctttccttctgaacgttcatacatgttatctgtttaacctctttagcatgtcaccttctacctttatattacgtacctttatattaggtaaattgtgacatatactatttacatattgacatatagtatatgctatgatcatttatcatataccatttatctgcatgttttatcttacctattaggctatatcaccatttaggacctattggatttacctttacataacttctgtgtactaccagtgtacaggtgctgcccatagaaaggcctcaataaacatttgtttgatacaaaacacatgtgtagaagaccatggaaagcgaccaaacatcaaagccatctcattacaaatttcttcaaaaggtgcttcctttaaaactcccccagtatcattatcccttgggttacattttctttgttctacaattaacaaacgttccttacaaatagagaacctttctgactcatttcatgagggtctcaaatttctatcttcttctttttttttttttttttttttttttttttgagatggtgtctcactctgctgcccaggctagagtgaagtggcgtgatctcagctcactgtaacctccgcctcccgggttcaagcatttctcctgcctcagcctcccaagtaggtgggattacaggcacacaccaccacgcctggctaatttttgtatttttttgtagagaccgggtttcaccatgttgcccaggctggtcttgaactcctagcctcaagtgatctgcctgccttggcctcccaaagtgctgggattacagatgtgagccacaaatccagcctcaaattcctatcttcaagccacaggaaacaactcatttcttcaagatataaataaataaataaataaagagcaaacaaaccccaagactagtattttggagggagacagaatttcaaatgtcaaaacaactttgctctcatcttctgagatgccctttagggtaaccattttttctaaatgcatcatgcttactattgcttgtggaaatttgcttattcaaatgatccaatcccttctccttgctactaaaagtgcagccacctaccagcagcatcagtggcagctgggagcttgtcacaaatgcaaactaacgagccctatcccagacatactgagtcagactctttggggcccaggaatcttaatttaacaagatctctgggtaaacgtttgagaaggacaggcctatcccatggccagagttacctttcgaaaacccatctcaacgtgtcatcagaaaccttcaatggccacagtataaagtccaagcctctgcagaaagtgaaggatcttatcatttaattgccacaatcttcccattaagtcaatcagcatgtgttgaccacctgctcacacgccaggctctcttgcacgtttggagaagatagcagtgaacttggctgacagccctgctctcatggaacttaccttctcagagggaaactgacctcagaactcatctcccaactaaccatcccattacctgtgttctactcacactgctgtcttcacccttctccaagtacatccacacattttacatttcatgccagggttcgtgctgtttcaaactcaataccaaccaggctgaaatcatcctccttactctgggcttctgctcgtcctctaacacagcaaaggctgcatccctagactgtgattcatatttaaatgtctttttctcctctgctgggcagtgtgagcctcaggggcagaaccatagatccttcatccttgtatacgtggcacctagccacatggcttagaataaatagcatttaattaaatattcttaaaaatacaactcagggatagaattttggcagtgttcaaaatgcttcctttggaaatctttaaattttcctctaaagccggtgtggtggtgagagcctgtactcccagctcaggagaaagccaggaggatccttgagcccaggagttcaaggttgtgatgagctgtgacgccactgcactccagcctgtgcgacagagtaagaccccgcctctaaaaaaagaagaaagttttcctctaaagtctaagaccttcttttttaatgatattcatttaaatagtggaaaatatcctttgacagtataattacaattttggcaatggtctaataaatggtgtaagagggtgatgaagatgggcaatgcaactgctattctaaaacgaactttaaatattaatagaactcattattttggtacattttatgactgaaggcaactccaaaaatgtcttgcacagtgacagcctcactgtaatatttttattctagagtaaggaattagaataacttttttttttttcattttatagacacagggtatcgctctatagcccaggctggagaacaatggtgtgatcacagctcattatagcctcgacctcctggtcccaagaaatcctcccatctcagcctcctgaatagctgggactacagggcacacaccaccatgtactgctaattttttaattttttgtagagatagggcaagattcctggcctcgagtgatcttcttgccttggcctcccaaagtgctaagattacaggcttgagccaccacacccagctagaatatcactcttttcaatgtttcaattctgccatgctttggtaaaactaaacagaatccctcttccagcaggtaaatcttctgttaagacaatcattcatgttttcaagaatgcattatgtatgggaggagggtgcggggaacatgtctgtttctaaaacaaaaaaaaaaaaagcaagaatattcagatgcggatgggctaccgtaagtcttccctatcatcctccctttttctacgcccctcccacaacttggcacttgaggcacctccagtgttccctggaagacattcaaaagcaaaataaataatggaaagaaaactgaagtctacgttggaaaacctttgtcctaatcccaaacgttatgacctcaggaaagtacttctactgtctgcacctcagtttcttaaaaggaaagctgaggttccttccagtttaaaatgctagcactttcgaatgttttcgtctctagagatgagagaacatgccaattcacctgcgtcccaacagcccttttgggaggtatgcacgcagctctacttaagatttgattgaatgaagtcacacaccattaaacattttcaacattcctatcctaaatatgccttcatttttgcattacatataagtaatataaccaatagctatagtaaacattactgaggctttcttttttttaagacaaaaataagtaaatgtctatactgacttcccatactgtctttggaacccactgattgagagaccagtatcctgcctggatattaatgggcacctgccacataaaagagagagtggtgggccaggcacagtgactcacgcctgcaatcccagcactttgggaggctgaggctggcggatcacctgaggtcaggagtttgagaccagcctggccaacatgatgaaaccccacctctactaaaaatacaaaattagcaaggtgtggtggcgcatgcctgtaattgcagctactcgggaggctgaggcagaagaattgcttgaacccaggaggcagaggttgcagtgagctgagatcgtgccattgcactccagcctggacgacagagattccgtctcaaaaataaattttaaaaaggagagggtggtgcattaaggagagtcgacagcagctgcccccgtccttaagaccacagtcaggactcaagcacaaaaagtgttttcatgaagtaatgaggctttagataaacataccacacttttctttgcaatactattttgcaaattaattaatttcaattaagaaatgtcaattaagaaaatgtgaaaatcaaaagaacatttttaccatggtgcagacctggatgtctccaacttttgagtgcacaggactcagggattttgtcaaaatgcgtattctcagtcatcagttccgcagcgaggactacgattctgcatttctaacaagttcccaggtgacgctgtgggccacatgtaagtaacaaagaggtagaaaacacagttgtccctcagtattcgccggggattggtcccaggacccccaggtgtacaaaaatccatgcatactcaagtttcgcagtctgccctgcagagcccacctgtatgaaaagtcaagggttccacatcccacaaatactctattcttgatctgctttgaaaaacattcccatatggggtggtggaccctcacagatcaaacatgttgctcaagggtcaactgtatatgccaggcagcaatatgcttcctaaagggactcattctgaagatatgtgatctaaaaattcactttttttttttaaataacttcaactgggaaaattccacgaagccagaccctgggctcaaagcccaggatcccagccacacatctcttaaaaataggttttcaaaatgccttgcattttttaaaaaagaatagcatatttgcctaaaattctagccaaaatgcttgatattcaccactctattattattttttgactaacttcttccttgttcagttctcacttcctcctcgcctgtcactaagctgagtcacaaagctgtcaacgctctgctgcttgccaggtagatgcaactcctttctccatttgtttatctcctgcaaagcggaataatttttctaaattcactcagattcccagtggcacacagtatcatgcagaacagttgtggaattaggaaaccaacaagaaattttgtacttcctgaaattttgtggttacttcaaatcatcatcctgtaaagataacaaggatgagtccctttgcaaagcaaaaatgctagttaactacaaaactggaatttaagtacggaaggtcaatttcaaatgaattcacaatgcaaaaatctttcagacacctgagaagtaacttgactattgaacactgtactcgtagagttaaaatagctcaagaagaacgcatatgcttctatttagtgtttttttttaatcctgttgcaaattctactattctagtattttcttatgtttaaaaatatcttaattctcatttactatccctggagcaatatccctggcaaattcttcataattccccatgagtcttccagcacagatgcagctttccaagtcaaaatttgtacaaacatcatctgtcaaacttctgcaaggtaatgacatactcatcctgagctgtcacctccccttgcagagactttgctaaaattcttagcatagcaaggactttcaaacagctttctccagcccattcactgtacaggtgaggacacggagaaccggtaacttgctttacttctacaaaaatgctacaatgcaaatttataatgctacggaaaagattatcctggcttcttcacttatgcattttctaataatctacagaaggcagagacagccaatgatgagaaataaaagctctctatttataaacacgtacctaagaagctactaataaaaaattctataaaaggaaaacgagaacactgaactctctatcatatttgaaaaagaaagggcagacatcgcacaattcaaacccagcttccagacttcagggagctctagaaacctgaccagcccacaacaaaagacccagccaccggactgggggttccacaaacagtcagccctcagagatcacccaacattggggctcagaatataagttttgcacatccccttttttgaattcaggaatgtcttccctgcccttaatcacaagcagacaaccagatatctgaggaaagctactaacgtggaagatagagaccaagttaaaccagaaaagcaaatcagaggacacagagactatacaagaagaaaattaaaatatatatatataccaagtacctcagaattacagtatccataaaacagggtgtgattttttaaatagttctagaaaacaaaaaacacaatagcagaagttttgaaaatactgacagaaggattagaaaataaagttgagaaaaatcttccaaaaagcagaacgagtccggaagggagaaagggggaaagggggggaagtagactagtccgggaggtccaaaaactgaaaagtacaattgccagaagaagaaaagaaaggaagctgagatatgaaaatatatcagtggaatctaagaaatatcccccaggaatgagtttctagattgaaggggtttactgagtgcccaatataatagttgctttttcttctaaacccccaagtcatggcatttgaaatttcagaacactagggacaaacagaagatcccaacagtttccagagagaaaaaactggtcacacaccagcagatacaaaatcagaatggccagatgtggtggctcacgcatgtaatcctagcactttgggaggccaaggtgggtggatcacttgaggtcaggggttcgaaaccagcctgggcaacatggtgaaatcctgtctctactaaaaatacaaaattagctgggcgtggtagcggcgcctataatcccagcaactcaggaggctgaggcaggagaatcacttgaacccaggaggtggaggttgcagtgagctgagatcgcgccactgcactccagcctgggtgacagagcgagactttgtctcaaaaaaaaaaaaaaaaaaaaaaaaaagaaatcagaatggtttcacatttcccattggtaacacaaagccagaaggcaatggagctcgcctccaaaaccctgaagaaaaatctacaactgggaatgctacactcaatctatcaatccaatgagaatggagaataaagatgttttctgcaatatctcaaaatttatctcccacacactctttgtcaggataagctcttccagcatggaagagtgaccccggaaagaggaccacatgagacacagcacatgggagaaaagtgaaggattccccagaacgaacgcgaagagggatcccagcatggcacttgtgtgtcccagacacggaactgcggctagagagccaagacacaatccccgagagttactctgtgcagtcactgtgctaagcagtgcacagacagcatctcatttaaattctacaataagcctggagatcagcaattattagctgctattatgggaattttaaagatggggaaagagtcagctaggttaatctccccactgtcacacagctttacatggcagagatgaaaattcaaacccaggcctgccacccttttacacctacacacgtgtccactgcaggattctgtgagataaaacagaaacctggaaatgtgaaggaaagaaaggaaacacggattaaaaaggcaaagaggacagacacaagaaacgggacacccaggaagagatgagcgatgggtgttatgctgttctgtatttatttcctattttaatgatttttccaaattgaaaaaggaaggggagaaatataagtgaacaggaggagaagaaagtaataagggggggaaatggaaagacataggaaaaagacatgagactaaggaatacaactggaatgacactctttggcattcagaaagtgtagtcttaaatagcatattctccctcgatgatgtgaagtgatacatctcattcattactaaatgttcaaatccaagggattcccaaattccttccaaccatcttttcggttttaaccaaaatgcaacataggctgggcgcagtggctcacgcccgtaatcccaacactctgggaggccgaggtgggtggatcacctgaggtcaggagttcgagaccagcctggccaacatggcgaaaacctgtctctactaaaaatacaaaaattagccagtcgtagtggcaggcgcctgtaatcccagctactcaggaggctgaggcatgagaatcacttgaacctggggagcagagggcgcagtgagccgagactatgccactcactgcactccagcctgggggacagagcaaggcactgtctcaaaaaataaaaaataaaaaaataaaaaaatgtaacataggccagaacaggcatgaactatgcgtgatgtgcttactacattcaggggttctagggcagtatggggcttgtctaactccatggactcctccacccataaaccaactcagatgtgtttgttcatatgcttttaaacaaataaaatgttttacacaaatgtaaaaccccacggagaaagaaaaaatataaaagtgtaatatataagttatccattccatagacctttacagaagctcaccttaacaatgctgttacttagatatggaaaactcatttgcctaacatctgcaaaactgctcagagataacaaacttaattctttttagatacctttcttaagagattaggcaataaacatcatttagttaataattttcaactaaagcaaatacattatataagttatacccaatagagttgaaatatccaattcagtaaaacaaactgttcagttaactagattaatggtagcctcattaacagatgttctgacttgatttgcgtgtttttcttacattttactctcatacaaaaatgtctgcttgccttacataaagatatacattgccttcaacagaacctaatttactttatcatgttttattctttactctcactttatcttagttacacaccatatgtgaccttcaaaaaccacagagagccaaggactatgagcagttcagaaatcccacggatttgtataattaaaaataatttttggccgggtgcagtggctcacgcctgtaatcccagcactttgggaggctgaggcgtgtggatcacgaggtcaggatatcgagaccatcctggctaacacggtgaaaccccgtctctactaaaaatacaaaaaattagccgggtgtggtggtgggtgcctgtagtcccagctactcgggaggctgaggcagaagaatggcgtgaacccaggaggcggagcttgcagtgagccgagattgcaccactgcattccagcattccagcctgggtgacagagcgagactctgtctcaaaaaaaaaaaaaaaataaaataataataataataataataataataattttacaacacctataggctattgatctgagttaataattaaagaaatataaaagaacatggtgctgaagtataatatttcatctactgaatcacaaatcttgaaaagaaaggccaatatccaatacaggtgaaattaatacaactgtaactattttgtggcatgataaatttattacaaaccatttagaacagtttgaatatatttggatataaatataaaaggtttgcatataaatataaaaaacatctaagaagtgttgttattttattcagcaatcttcctagaattaggaaaaaactgaaaagaaaaagaatattaaaaaatagtccctacaataattattataagcagcctacttaataaaaagggtaacggattaataagtaaattatattacatcaactccacatattatgctgccacagtagcactgtaaaatggtttaaagcatttgatcactttgtatttaatctattcattaaatttttttgatataaaaaaatttaaaaaataaaagtcatgcgtaattctaccattaagagataactacagctaaaactgttacactttttttactgtgcaacacatgcatttatggcagagttactatcatcctatatatgtagttttattgttaaatattttggttgttttcagtattttacaacactacaataaatatcactgtgcaaatctcagatgattttcttagcatacattcctaaaaggagaactattgagttaatggtatgagtagtgtgccaactggtactcccataagtgagtgagtgtgggtataatttgtaatattttttaaaagaacagactgcaattttttttttttttgacagggtctcacgctgtcgtccaggctggagagcaatggtgtgatcatggttcaccatagcctcaacctcccagacaagtgatcctcccacttcagcctcctgagtagatggaactacaggcaagtgccaccacacccagctaattttttttgtattttttgggaaaacatgaggtctcgctatgttgcccatggtggtctcaaactcctgggcccaagtgatccacccaccttggcctcccgaagtcctgagaccacagacatgagccaccgcacccagcccagattgcaaatttttagaagtgctatagcgcgtatgaacaaaaactagaatatacaagtaaccaagttttaaaatttcagttaggccaggcacagtggctcacacctgtaatcccagcactttgggaagctgaggtgggtggatcatggtaaaacctagtctctactaaaaaacaaaaaattagccaggcgtggtggcatgcacctgtagtcccagctacttgagaggttgaggcaggggaatcgcttgaacccgggaggcggaggttgcagtgagctgagatcgtgccactgtactccatccagcctggcgacagagcaagacttcgtctttcaaaaaaaaaaaaaaaaggaaaagaaaaaacatcagttaatgtgtagccatattgctttacagtctaaatgaataacttctgggctagcttcaacggacgccatcattctcagattttagccctcaagaatagaggctccctagtttgctttttgtttttgaggcaatagagtctcactctgtcgcccaggctagagtgcagtagcgccatctcagctcaatgcaacctcccacctcctgggttcaagtgattctggtgcctcagcctcccaagtagctgggactacaggcgtgcgccaccacatctggctaattttttgtatttttagtagagatgaggtttcactatgttggccaggctggtctcaaactcctgacctaaaatgatgcatccgcctcagcctcccaaagtgctgggattacaggcgtgagcctctgcacccagcccaaggctccctagtttgattcacaccacataaaatgcctctctgacccacagctaaattcttagtgtcatggtattttccctccagaacacagagtagtaattctgacttaatgacctttctgcaggaacgccactcgtggcagcaacattcctttcctttaaagtggcttttgcttagctgtgaccttagcatttcatcctaacccaggtgaggaatataaagtcattcattataatattctccctcaatcacttgagtccaggaggtcgaggctgcagtgagccatgatcgcaccacggcactacagcctgggcaacagagtgagacccttaatatacatacattctccctctttgtttatgttggaaattttttataataaaaaaaatttaagtacattaagttttaaaacaactcatagcaaaggaatgttcctaagaagtgccatctaattttgtaagtacagtcatgccctgcataatgacgtttcagtcaatgacagatggcatatgccacggtggttccataaggctataaagagctaaaaaattcctactgcctactgacatcatagccgtcataatgttgtgcaacgccttacgtgtttgaggtgatgctggtgtaaacacacctgcgctgccagtcatataaaagtttggcagatacaattacgtgcagtatataataataatgagaataaatgaccctgttattggtttatgtatttactgtactttttatcactcctttagggtacactccttctacttacatgtattttttaaagttaactgtaaaacaaccccaggcaggtccctcaggaggtgtccagaagaaggcattgttatcacaggaggtaacagcttcatgcagttactgcccctgaagaccttccagtgggacaaaatgtggaggtgcaagacagtgatattgagaatcctgacccttgtctaggataatgcgtgtgtttgtgcctgagtttttaacaaaaaagttttaaaagtaaaaattgaaaaaaaaaaatttagtagaaaaatgtttacagagctgggcgcggtagctcacgcctgtaattccagcactttgggaggccgaggcgggcggatcatgaggtcaggagatcgagacgagcctggccagcatggtgaaaccccgtctctactaaaaatacaaaacttagccaggcgtggtagcatgtgcctgtaatccctgctactcgggaggctgaggcaggagaactgcttgaacctgggaggcggagcttgcagtgagccgagattgcaccactgtacttcagcctgggcgacagagcaacactctggctcaaaaaaaagaagaaacatgtttatagaatgagaatataaagaaagaaagtatttttgttcagctgtacaatgtgtttggttttaagctaagtattattatgagtcaaaaagtttttttaaaaaaagtttatcaagttaaaggtacagtaacctaaggttagtaatttactgaagagagaaatatattttaaaaataaagttagtgtagccttcatgtacagtgtttgcagagtcgtaggacacacgactgtccttggccctcccattcactcaccactcactactcacccagtgcaacttccagtcatggtaagtgccctatacaggtatttcaatgcttatcttttattctgtatttttactgtaacttttctatgtttagatacacaaatactcatcactgtgttcaaactgcccacagtatcctgtgcagttgcgtgccacaggggtttgtagcccagatgcaacaggtgatcccacacagcctaggtgtgcagtgggctgagtgcagtgggctgtgagcctgggttcatcaagcacgctctgcgatgttcgcagatgacacaattgcctaaggacgcattctcaggagtatccctgctatgcaaagcctgactgtactccctgttataaccatgagctgttttccacagcagcatggtcatcactatccccagacaccaccaaatttacatctactcagagaaataattatattcaatttaaaattttaaataagtactacacaaagatactctggaaggtcaaaagccgcatcatccttggcctgaggaaatcaagatgatcacagggctgtgcgggagaccagtagtgccaaaacacaaggtccagtaacacactaagacgaatcccaggaagacagcgggaggacatcgcacaacgtctcagtgcacaccattcagccactcttttctcacccacacactgatgccaacttcctgagtaacattccgagtaaaacgtgcacgactcactccagacagtccacttagtgtccacccacactcacgtggcataatggaaaggacgcctgctaggaagtcagccaggcctggtttcccatcccatctctgccaccgacttgctgtgagaccacaggcaagctgcgagccctgcaaagcagagatgacgcttctcacctcagcacttagtatggcacctggtgtggcacaggcacgcgatgagtatctgttgagtgaatgggagggtggcggaatccccgccgtgaagctgcctacacgatttcaatgggagcctcccactcccccgcccccacgcctcccttcccttctctttctatgggtctctgccttccctccctcagaaacgtgctagtcccatggcgttcataattgttctttctaaatacattccaaatcatatttctttttttgtttgttttgttttgttttgagacggagtctcgctctgccgcccaggctggagtgcagtggcgcgatctccgctcactgcaagctccgcctcctgggttcacaccattctcctgcctcagcctcccgagtagctgggactacaggtgcccgccaccacgcccggctaattttttgtatttttagtagagacggggtttcaccatgttcggcaagatggtctcaaactcctgaccttgtgatccacctgccccagcctcccaaagtgctgggattacaatacccagtgtgcctttcttcattcattcattcaggagcctggctgtgctctagacactgcgaacacagcattaagtaggctcggcgttgggagcccgctgtgatacagcccgtcggctcatggaggagctgaccttccaccgggcaccatgggcacagggccttgggcccacagcacttttggggcccatgaaaattgtttgtttccacaatctcagaagaaaaaacatgaactattaggatgaaaaaaatgttttactatatagtattaatatttcatttgcataccaatgcagttgtaaaatataatttgtaatatctttttaatgaaggaaggggcctacagaggcacagatgcctcaggctcatgagtgtcagatgcagcccaaggaaacacatgctaaggatggaatgcaaaggagccagcgagtaagattcgagaagggcgtttcaggcagggagcatagctgctgcacaggtcctgaaacagggcgacggccataacagtgcgagggaaacaggtgacatgacaaaggccgggtgtggccacatctccaaggcataaagacaaagtgggacacagttaaaaatgatacgggatttaggccgggcacagtggctcacacctgtaatcccagcactttgggaggccaagtgggtggatcacttgaggtcaggagttcgagaccagtctggccaacaaggcgaaatgctgtctctaataaaattacaaaaattagccaggtgtggccgggtgcagtggctcacgcctgtaatcctagcactttgggaggctgaggcaggtggatcacttgaggtcaggagtttgagatcagcctggccaacatggtgaaaccccatctctactacaaatacaaaaaattatctgggcgtggtggtgggcacctgtaatcccagctacttgggaggctgaggcaggagaatagcttgaacccgggaggtggaggttgcagtgagctgagatcgcaccactgcactccagcccgggtgacagtacaagaccctgtctcaaaaaaaaaaaaaaaaaaaaaaaaataggcaggtgtggtggtgggcacctgtaatcccagctactcaggaggctgtgacacaagaatcactcgagcccaggaggtggaagctgcaatgagccaagatctcacaattgcactccagcttgtgtgacagagtgagactttctccgatgaagaatataactttctctgatgctattgaaatgcctcctttcaatagcgatggaaagtggaagagtaccaggagtagttacaaggtgtagatttccacataattgaacttgtccaactcctaaaactgtttaataacggacagtttagtgaagtaacaaactttccatctcttacatccaagcagaggatagaagccaaatgtcaggaatcttgcaaagggaaccctgcataaaaaggaagattgaacaagaggacaatcaaggtcctatccattcctacaggcctaaattagcatcttctgcatggaagtcttcaaagggaagcagaggtttcctgcaagtggggcaaattaaactacacgagaggccaggcgcggtggttcacacctgtaatcccagaactttgggaggccgaggtgggcagatcacctgaggtcaggagttcaagaccaaatggccaacatggtgaaatgctgtctctactaaaaatacaaaaaccagccgagcgtggtggtgggcacctgtaatcccagctactcgggaggctgaggcaggagaattgcttgaacctgggaagcggaggttgcagtgagccgagatcacaacagagcgagactctgtctcaaaaaaataaaaacaaaccacatgagatatgaccttaccccaatcagaatggccatttattaaaaagtcaggaaacaatagatgttggcatagacatggtgaaaagggaacacttaaatactactggtgggataataaattagtacaacctctatggaaagcagtatagagatttctcaaagaactaaaagtagatctgccattcaatccagcaatcccactactgggtatctaccaaaaggaaaagaagtccttatattaaaaagacacctgcatgtgtacatttgttgcaacacaattcacaattgcaaagatactgaatcaacttcagtgctcatcaatcgatgagtggataaagaaaatgcgatgtgataacctgaggtcaaaagttcgagaccagcctagccaacgaaaccctgtgtcaaccaaaaatacaaaaattagccaggcatggtagtgcatgcctgtaatcccagctactccggaggctgagacaggagaattgcttcaacccaggaggcagagtttgcagtgagccaagattagacgactgcactccagcctgggtgacagaggaaaaaaaaaaccaaaaaactcaaccttgtaaaaataactcaactcttacctttgattatggcatcctgtaatgaaaattttaaatcctatatattctaaaggttttactttttaacttctggatattagtcttacttaaggacttcccagacaggtgtgatggatcacacctgtaatcccagaactttaggaggccaaggcgggtggatcacttgaggttaggagttcgaggccagcctggccaacatggtaaaaccccgtctctactaaaaatgcaaaaattagctgggcctgatggcacttacctgtagtcccagctacttgggaggctgagacaggacaattgcttaaacctaggaggtggaggttgcagtgagctgaaatcacaccactgcactccagtcagggtgagagtgagaccctgtcacaaagaaaaaggaaggacttccctaccacaagtttgttattataatatatatgaagaatataaacttttaaatatatggttaagttctttaatccatatgaaatttattttggatagattttgggatggaaatttatgctaacaaatttagcatgaggtaaaaaactttccctttttttttctttaaaaaaaagacagggtcttactttgtcacccaggctggaatgcaatggcatgatcatggctcactgcagccttgaactcccaggctcaagtgatcctcccacctcagcctcacaagtagctaggaccacaggcatgcaccaccatgcccagctaatttttttattttttgcagagacagggttttgctattttgcccagactaggctcgaactcctgagctcaagctattggaccacctcagcctctcaaagtgctgggattacagatgtgagccaccacgcctggtccctaacataactttcttccaaataactggccaactgtttcaacctttttctgtgtgtgtgtgtgtgtgtgtgtgtgtaaacagaaaagtaaaatttctattttcatttgcaattccttttggttttcttttccgtttgtttgctttttgagttttttgtgatttttttaagttcagaaataaatgtgcagttttgttttataggtaaacttgtgtcacagggtttgtagtacagattattttgtcactcaggtactaagccaagtactcaatggttattttttctgatcctctccctccacctgccttccatcctcaagtaggccccagtatctgttattcccctctttgtgtcatgagttctcatcatttagctcccacttataagtgagaatgtgaggtatttggttttttgttcctgcgttagtttactaaggatgataacctccagctccatctatgttcctgcaaaagacatgatctcgtgcttttttgtagctgcatagtattccatggtgttgttttttttttttttttgagatggagtctcgctctattgcccaggctggagtgcagtggtgcgatctcagcttactgcaacctctgcctcccaggttcaggcaattctcatgcctcagcctcctgagtagctgggaatacaggcgcgtgcccccacagctggctaatttttgtatttttagtggagacggggtttcatcatgttggtcaggctggtcttgaactcctgaccttgtgatctgcctgccttggcctcccaaagtgctgggattacaggtgtgagccaccaggcctggccacattttctttatgtaatctgtcactgatgcacagttaggctgattccaagtctttgttattgtgaacagagctgtaatcaacattcacatgtgtctttatggtaaaatgatttatattcctttgggtatatacccagaaatgtgaaaagataatctacaaaatgggagaaaatatttgcaaatcattcatctgatgagagtctagtagccagaatagataaagaattgttacaactcaacaacagaaagacaacaactcaactcaaaaatgggcaaagcaagaggtcaaggcggtggtgagctatgatcacactgctgcactctagcttgggtgacagagcgagactccatctcaaaaaaaaagcttttttaaatgggcaaagcacttaaacagtcatttttccaaatcagctatacaaatagccaaccggcacatgcaaacatgctcaacatcactaatcattaggcaaatacaaatcaaaacaacgagataccacctcacgcttactaggatagctactatttaaaaaacaaaataacaaatgttggtgaggatgtggagaaattggaacccttgtgtatgggaatgtaaaatggtccagtctctatggaaaacagtagggcagttcctcaaaaaatttttaaaaaatttccatatgatccagcagctctgcttctgggtatataccgaaaagaactgaaagcaggctctcagaaaaaatatttgcacactcatgttcatagcagcattattcacttgggtctgttgatctgtccatccacagataaatgaacagtggcctatacatacaatggaatattatttcgtcctaaaaatgaaggaaatcctgatacatgctacaatatggatgaaccttgaggatattatggtaaatgaagtcagtcagtcacaaaaagtcaaatatcgtatgattccacatatatgaagtacccagaatagtcaaattcctagagacagtggagcggtggttgccaggggctggtaaatggggaaatggggagttacgtgttcaaaggatgtagactttcagttttacacaatgaaaagagttatggatgggtggtggtgatggttgcccatcacatgtatttaataccactgaactgtacacttaaaatggttaagatggtaaatttcatgttatgtgtatttcatcacaataaaaaacaattttttaatcattcttcctccatggattttaaattttgtccctatgacatataaattcctatacctcacgtgtatacatgtttctgagctccattctgtttcgtttattctatctcggcatttttcaaacaataaggcacaatccattggtggttcctaaaataggttgaatagattataaccaccattattgttgttatcttctaatgaagtagaataggatagaaaacagaatacgtctaacatagtaaagtattaacccatgaaatttgtttatatacatacatatgtataggtggtgttggctgaattgtaaaatacatttgttactatggatttgtagctcaaagtttaagaaacactgctgtaattatccctatgtcagtattatcccattccaactacttcatagcaataaaatttataaagtgttttaatgtctgatattaaaataagcaagcaactcccttccctccccacctcttatctttcaaaatttttcaggtaaacttaagaatcagcttatcaattaaaaataatacttttgatattccaattaggatgtatttaatgtacagattaatttgaatgtaactgacatctttgactgaattttcctatgtagaaatatagtatttccttttattcagaaaaggaaatacatgccatatttctatttcagtagttttatgatttattcacaaaggtcttaacatgtatcttgttagatatgtccctaaataattgaagtctatggttgatatgggaatgagttttgtttttgtttttgtttttttgtttaagagatatggctcttgctatgttacccaggctggtgtcaaactcctggcttcaagcaatcctcccacttcagcctcccacagtgctgggattacaggtgtgaggcactgtacccggccctgagacttttgagataatttctaactggttatttcaagagaacaaagataatattgatttttacatatcactcttataaccagctgccttaattaagtctctaatcagtcctaggaggttttcccccatttattgttacgattttctggtaggctattatgacatctgaaaattatagtttttcctatatcttttcagtttttatatatcccttttttaagaaaaatcactagctagaacgtcaagttcaatgctacttgagttgtgtcttgctcctaacttaatctgttccaccattaaacatattcattgtaagtttctatcagatatattttatcaattaaagacagtttcttttgatttacatcttattgtttttatcacaaataggtgccgaatttcatgaaatacttttttagacttctgtcataaatatattaatttttcctttaatctgttaaagtaatataatttattacattacaaaagttactattattgaaacatccttgcattcttgtgatgcaaatggcttacttcgacatgggatatgttactctttcaatataattgctagcctgaattttatttaactttgtactctcatatctatgtacttgattttatatacatacaactttgtgttttatttggctttagtatcatgttatattagcctcacagaaagaattacaaagtgctctatactataaaatagtcttataacatagggaaatctgtttctttaggatttggtaaaattcacctataaaaccatatgggcctcacatctctgactacttgttaaatttttaccatgattattgaccaatttaggtttttaacctctttctgattcaaacagaatcatctatttcatctacattttccattttttggttacatgtgcatatatttgtatagtattctcatctatatacatagtaatatcccttttcttgtttcatatatgttctataattatacattttgttctttttcttaatgaattcaccaaaggtttgtttaatttattgatctattttagaaaacagtttttggttgtcagtttttggttgtattttttaggtttattggcttatcttcatttataaagataaaagtagactgggcgtggtggctcatgcctgtaatcccagcactttgggaggccgaggcgggtggatcacctgaggtcaggagttcaagaccaccctggtcaacatggtgaaaccccgtctctacaaaaatacaaaaattagccgggcatgatggtgggtgcctgtaatcccagctactcgggaggctatgacaagagaatcgcttgaacccgggagctggagggaggttgcagtgagccagtatcgtgacactacactctagcctggggactgagtgagactccatctcaaaaaaaaaagagagagagagatcaattttttttcttttggagggattgaggagatactggttaaaaaatacaaaatttcagcacaatgaacaaatgttcttaactgaaaacagaggaaaaaagttttcttctttctgctttgggtttgtcttgtagtggagggtgttcctttggctcacttacttcccatttttctaataaatgcatcttcttttcaatgtttcttggcctcagcccaccagaacatgcatctgatgcatgttaagactctggggttgacctccatgcctgttcctttcctcgtcccgcttcctatctctgactttttgatcgttctgcaatgttttgctctctatcttccagaccgctaatttggtctttaattctatttgcttctcaagccaacctagttaaccttttaagttcaatcaccacatttttaatgtccatgaactttcttgttctaaaagatcttttttcacaacaggctacttagattcactatacagcagctcaaatctctttgaagataccgactaacatgtttttggcttctgctatgcgccccaaagtctgcttactctgggctttttctttcatactatttattctcctcaaatgtctggtgatcctttgatgtgcattcacactttggaataaaagactgggccaatcaacaagggaaaccactgcatgcttccagtctggtattaacgctctcctggggaaggccagctacctgcaggctccgtgtaagaggacagaaagtgtccaatgatgggctttgctttaaggtatacaagtaaacaagcacggaggcagagtgggggacaaacaccaaatctgccaaaacagtctctcctccagtggcgaaggacgttcacagataccgcctgctagagggcctacatttccttcccaggacccctgttactgcaggagcccgcagggatctgacactctgctcggcttctctctcaggccccaacaccccctcaaggatccctccccagacacagttctcagtttttagccagagaccattgtataaatgtaatgcttcgatttcctaaatattactctagggccccttcctgttggtggttgttagtcactgtaaactcagcttttaatcccccccttttcttttgcacctgtgttttgagttacaattgttttgtttttgttttccttttgtcaatataatcccatctgttttcagtcttccaggaattcttcataacttttagtttaatagaggtaggcatcctttcaaattttctaatactattacagatgttttaaaatatttaccttttgttatttaaaaagatttttggcaagagagaagctggatgcatgtgttcagtctgccattttactcctaaaaatccagattgtcctcctgaatgcctaaatacttttttctaatttaaaatgctttattcaaagcaccctaaactagtacttcgctaggaaactgaaaaatattcctcttaattctgcttgctagtgaacagaacagactttaggcctcttgaattcattttaaaagtaactacagtccagttaaacaaggtaaggtccacaaaagaaaagacgtttaagcaacattttccaaagagagaaaaaaaaacacatatatgtaaggtttgatgagacaggcagtcctagaaaaacaaatggtacttcaccagatttcaaatgtaaagatttattcatttacaaggaatcaaaagtttgatccaataaaaaggcagttacaataaatctaaagccaatgaggattaagtttgattttttcaagcttgatttgatttctataaaagtataaaccccaaatatattgcttctacacattatatgcacatcagatgccaagtcaacgagtatttcataaatgtataacataaatatttaagaaagcaaaagagtataaagaaaagatgtggcctttgtcttttaaaaacagaaaatctgaataggaaaaaactatacacgtatctaaatctccacacagagataatgatagacgtagaagatggtgtcatgttacatcccactttttcagctcttacagaattgctacagtaattcacaagtatggtgagggagggagagtagctgaaacaggttgttgttgttgttgttgttttttatctgttattttaggttttactaatggaagtattgagactagaacaaaaagcacatactagatagatacttacctgaccaatcctggcaagaggactattgtctcactcacatggaattttaaaaatctgaaagtcttacataaaaatccaggtttccagtttgtcttgagtagtcagaaaagctgacaaatccagccccacattcctatgggaaatcatcagctggtgtgctggtaaacgttaacaactggctctctatagaagaaaaacaaaagcaaaagcccctgatctgtatagcatttgccatggtgtaaatacacccatcatggctgatttcaagctcccaacgtgatgcctggaaatgacaggcacaatcagctcatggacaacagtggccagagctgagtggtggctgccccttggacaggagttacgggccttccgtcctcactgctccctatagtcttacagtggctgctacctgcactggcaccagcccgccccacccctttctctctcttcacccccaagaattcctgagccagatccaagctggtggtagtgctgggcacaatgtcctcctaatcctcatcagaccacatggaaaaatcattgcttaggtaccacattttaggaggggcactgccaagcctgagtaggtaaagacagcaatgagctcagaagacatctccaacacaggatggctgacagcactggagatgttcacaccagatactgaccggggcagtgactctcaaagtggagagagaagagatgatgggtagggagaagtgcaccaaatgaaaaaaaaaaaaaaaaaagaactacttcatccaaaaattcttgactctgatatgttaaattcaattgcaaatgacattaaccatccacaacacttttatgtgtattaaaggaaaatatggatctctaaggattgtgaaacatttgtttaaaggaaacagtcaccctcctcaagtgtctaaacagctattcagtggaagaatctattttcagcatccattatgctaattaacaaggcatgttattttcaccagtggatatccaatttctaacatttattatgctaatttgatctgatataaaactataaaaatagcagagacactggtagtagctgtctctggagggcagcccttctgattaaaggccagatgtctagccctggatgcccccacttagagaatggcttaaataagcacctaatccacctgatgttttatgaagccttttgaattagaatagactactgggagatggtattttttgatgtcattgttcacaaaagggaagcaactgaaagcgccgacttttagaaagaacagaaacatcagtgcttattttaaacctaatgggagcttaggaacatggtccagtcagaggaggagcgctcccctgtggtgcctgaagcactcgactgtccacagctgccgacactcacctgggaactactgttctgatgatcccagcagcaacgcacaattcagtgcgccagcaccaaaggaggaaggaagacagaggtttgtttgggttggtttttttgagggggggtggggggatgtttattttactttaatcttgaattaggcatccaacttctcctaatttttattctcttaattttttctctgatacctcccccacccagtctactgcaaaggctcttgctataagaagtaatgaaaataggccaggcgcagggtctcatgcctgtaatcccagcactttgggaggctgagacagcggagttgcttgagcacaggagttcaagaccaacctgggtgacgtggtgacaccctgtctctaccaaaaatacaaaaaattagctgggtgtggtggtgtgtacctgtggtcccagctactcgagaggctgaggtgggaggatcacttgagccccagggggcggagcttgcagtgagccaagattgtgccactatactccagtctgggcaacagagcaagaccctgtctcaaaaaaaaaaaaagtaaatgaaaatgttttgtaaactacaaagtattatcaaatagaaatagtattccttggaatttgtacattattagtagcaacagtgatctttaaaatgagtcatttctgctagtgtttaataaattaattccttagagataagcctccctgcaggggctacttcattaccaataaatgtttactaaatgcccaccatatgcaccaaatggtagacgattggaatacaaaagcagaagggagcaggattctcgtcctcaacaggcaaggatctgctatagactcacaccatccttcaagtctggccaccctccccatgacactcccttctatgttgcctctgggttatcttgtctctaattaaacactttggcaaagtgggatctcgttacctggggaagcagcccttttcccctgaatcagttcctttccttcagttagctgaggtacttactgggaaagaaaactccatacatatgaaggggagtcctgtggcagcgtgcacctgagccatcacacacacaagagggcagagccatgaacgggggatgaaggactgtccccgagcacacgctaccacacgtcctgaacgtacggctggttacagctagttaatattttggaaatgctattttattggctaggaagccttttccaaatgaaaatctctttactgatagattagtgaaggtagtatagaggagttttattttgtttttgtttttttaatcagcagaaaagtctttcccgtcctctgggcagacagatagcagagaattacgcgcttaggtttcacagccaggctgcttccgttcaattctcagcactgccacaaccagctaagtgtacctgggcaaactacagaagccctataaacctcagtttccttatctataaaatgggactaattatagtacctacttaataggggtgttctgagaactgaatgagatgatactgtaatccttcaactgaggtccccagacaaatgctcaggagttcatgagaaatttttacttttgttatttcatggagaatcttttttaaaatttgacataagcatcctctgaatcagatggctaggtgctatgtcaccaagtattgctgtaagatttcagtgactatgtttgtatttttctggtctaatgaaaaaaggggtcaggcgcggtggctcatgcctgtaatcccagcactttgggaggccaaggcgggtagatcacttgaggttaggagttcaagaccaccctggccaacatggtgaaaccctgtctttactaaaaaatacaaaaattagctgggcatggtggccagtgcctataatcccagctactggggaggctgagtcaggagaattgcttgaatctgtagggcagaggttgcagtaagccaagattgtgccactgtactccagcctgggcaagagtgagacactgtctcaaaaaaaaaaaagaaaaaaggacagagacaaacccaatatataactgaggcatttgcactaagaaatagtcaaattatgtcaccacaacctgtatgatgaaaaattttacaagagtttgcaagatgaaagtggaggggaaattgcattagccggcaagtggcatgataggtagactaacattacagaaccaaatccggcagactggcagcatatgccacagttgtggaacagaggtttggttgcagcagatcttcatctgttgtgtcacggctagcttttattggctatatttagtttataaatgtgtattctagttatgaagttgtaaagaaactgcaagcataagggccaggcccatttttatgctttatatattcaagtaacataataaagataatcatattgtacttacgtaagggaatgttctcattcttttttttttttttttgaaatggagtctcactctgttgcccaggctggagtgcagtggtgcaatctcggctcactgcaacctctgcctcccaggttcaagcaattctctgcctcagcctcccgagtagctgggattacaggcgcctgccaccacagctggctaatttttgcatttttagtagagacggggtttcaccatcttggccaggctggtctcaaactcctgacctcatgatccacctgcctcagcctcccaaagtgctgggattacaggtgtgagccaccatgcccggcccaggaatgttctcattcttaagaaatgcacactgaattctttaggagtaaggaggaatgatactggccacttactctcatatagaaaaataatacccaactatatatacatacctatgtgtgtatatatatataaaacatgtaccaaaagacagagagaacatgtgcatgatgaaggaaataggggtagataaaaacaactggtgaatctggttaaaggacatgtggtagccaaagaactatagcttctcataactagaaggaatgcacttaaaagttcagatccagagttcccctaggaggatcattattagaccagtgattcgtgtggggaaagggacctgatgtcagatgcacctgggaaggctttgtcagaatgccagcaagtaccccgtctcctctctgaggatcgcggatagcagcgagccactcttatggatgaaaatgcacggcacacccctctggtattttaggatatgaaagtaaaaatcactgatgcagtgatcagataagcctccaaactatccgaaatgatcacagaaggaagtacttaatgaacactacagaagagctggcagaaaaacgatccaaaggccatgttatattgagcattatttttagacttaacttttctaaagtgcaactttacaaaaccaggagtcctcgaaatacatagagaaacagacagacataggcgacaaaacaacaactgcatttcccgtttgggctttcctgatgaaattctcccacagttgcacacacagttgctagaaagcaagagtacagtgctctttccctcactaagggaaaaccagactcaacaccaagactccaaggggaatgggcaggaatgacatcagtatgttgttctctttccagggcaccagaggacttggcactctgatcacaagtaaacacaactactccattagaggcagttcctccctattctaagcctttattattcctgggttttagagtcagtactccagaaaatggtcactccctttggtgaaacctatttgtctccctcctgtgctctggggcatgcctgcccctttgctgtaccatgcctcaatcgagtccaccttgtagatgctgatctactccggcatgtctgaatattaccggctccttttattttcatggcccacgtggcagtcagatcatcccagtgcatacaacggaggagccaggagtaaagtttatcacacgaaggagatgtaaaccaaatcatgttttttcaaactgtcggttccaatgtgttagtggatcctaaaatcaatgtaaggagccatgactcaacttctatttaaatagagtgcaaagaccagaaaagacacatcaaactgcactgtgcaaagtaagggtaaccattgtctcctctttttatttttttaaacatattttagagacagggtctcagtcgtcgcccaggctggagtgcggtggcaccatcacagttcactgcagcctagtactcccaggatcaggtgatcctcccacctctgcctcccgagtagctgggaccccgccgggtatgtgccacccatgcccacctaatttttaaattttttgtagagatggggtctcattttgttgcctacgctggtctcaaactcctgggctcaagtgaccatcccaccttggtctcccaaagtgctgggattagaggtgtaagccaccacctgagccagtactgtctcttaaaacttttggattggttatctcagtatatgtatatgaagatcacaatatgaaatggcttttttgagatggggtcttgctctgtggcccaggcctgagggcagtggcgcaatcacagctctctgcagcctttaactcctgggctcaagccatcctcctgcctcagcctctggagtagatgggactgtaggcacacaccaccacacccagctaattgtggtttttttttttttttggaggatgaggtcttcctatttttcccaggctagtctcaaactcctgggctcaagcaatcctccctcctcagcctgccaaagtgctggcattacaggcatgagccaccatgcccagcctaaaatgcttttttactgtgtgccacagtcaaccatattcaaaagccacagtattagatgctgagagaaaaggagagagaaagagacagaaagatcaggagtgggcccagctgaactagtcacaggagcaaaccccataagaggttcacttggctgatgcagaagccgaccagaagtcaccatgatcttgaggaaagaaatcataagagaaaagagtatatgagtgcaactaaacattacgttatcattaagctgacctggtttgctttcctttttttaaggcaaatgtagactacagcctagaaatataaacatattccatacaagagggccatgtgtccccattataataaaagcttgggttcttaggaatgcttacttgaaaggagtatggtaatcaatgcttcatcaattagtcaaccttcaataatcatctccaaacaaggagttagtgaatttcttggggcagatgcaaacgcaacccctgcaaaagctgctgtccttgccacatcactcacaccagccccatccagccttgctgatcatctgcatattcattcaaaagcactattccctccaccaaaaccctcaaagttttaatttaaagttattttaatctaagtgaggaagtcagcggatgcaattagatcttaaaattagaagatatggttaccaaacttaaccattttgtaaacattgcaataaaatggaatatcatgttaaagacatgccaaggtgttgttttatacattagcaccaagcaccttgccctcccattttcatcaatttaccctatgaagaaacagctggaggctggcacagtggctcacacctgtaatcctaggtgtgaggattattttgggaggccaaggcgggtggattgcctgagctcaggagtttgagaccagcttgggcaacatggtgaaacccctcctctactaaaatacaaaaaattagctgggcgtggtgacacacgcctgtagtcccagttactcaggaggctaaggcacaagaatcatttgaacccgggaggcagagattgcagtgagccgtgatcgcaccactgcattccagcctgggcgaatgagcaagactctgtctccagaaaaaaacagctggaaaaaagctgggacttcccagcaccagtattaccaatcactgaaaggagaggttcctcaagcacaaggaagaacagcaatctcaagttgtatttccattcagtaccttccagggttaccctagacactgattacatcaatgtctcatgagcagtggaatgattattttaagtaaatttatcccttccaggccatccagataagcaactattgtgttactacaaaaccaccattttactatttattttagctctacagtgtactattgaaatatttcttttattctccactagtagacatactgaagccttaatactatcaggtattatagactcaagtcataataggtactgttcccttcaaaatgctgaaacaataacatcctcaaaaatccccaagttttcagttctccaggagcaaaggaaaagagaatcatttaggtcaccttgatgagctgggaaactgatctcaagtagtagaacatttttctgtttgtaataagaggcccaaatcagattacattcacaaggcttttttaaagtgttgaggagaacgttaacctcccctaaagtctgagagcaatttacaacaaaagctaaaatagaattaatgtagggcagagaaagctgagtcaggctgaatcagcccaagtaagtctaagaaatccactgaaagacatcgaaacctaatgttcaactttgtctataaattgtatgacttttcacacacttacataataatacataactaatgaattaggtaacagaaaatacaatgcctggttttcgagctcagcatacttgagagtggtacacataacacaagagtaagaaaggtttcccaaaaatgttaataataattgaagacatctttggacttttttcctctcattcaaatgtaaaaaatgatcctaagaagctgaaaccatgatacagggattctagaattatgccagcccatctctaaagcaactggagtcatttgagtcaaaagaatgttcggctaggcatggtagctcacacctgtaatcacagcagtttgggaggccaaggcggatggactgctggaggccaggagtttgagaccagcctgggcaacatgatgaaaccccatctctacaaaaaaaagaaatagaaaaattagctaggtgtggtggcacacgcctgtaatctcagctactcaggaggctgaagcaggaggattacttgagcctgggaggcagaggttgcaatgagctgagatcatgctattgcactccagcctaagtgacagagcaagttctgtctcaaaaaaaaaaaggagaatgatctaggataaagtctacagtctattttctgattgttagagccttataagcgaatttatcctcattcttcaaaaacaccaatgggctgtgttcaacacagaaggaaagtaagagttcctctttcccttagcagtatcgttttgtttctccgaaaacagctctcccaaaccataggttccaaagggagtcttgcatctacattaccagctgtgcttgtccccacttctatacattttacagccataagcgtctgcacacaaacatattcatgagtcccatgaaggcaggaactgtcccttctttatctttatatgccccttatatataagggttcaatcatcactcactaaattggaaactaggtaggcctccaactggaacagaatgatcaaaagaggagacaagaaagtctttactctccccacttaaagacacaaaaggttaccctgaggtaattatttctatttttcattgtataaacagtattttgttttattattcctaactaaagttgggcattgtaaaagagagaaattcaaactactaccttatataaaaacttctaaactgactatattggcgctcaacaaagtctgcaaatagctattcaaatcagccacttctccagggtcgtcactgctccctacagtcttacagtggctgctccctgccctggcaccagcccgccccacccctttttctcccttcacccccaaaaactcctgagctagatccaagctggtggtaggcctgacacgatgtcctcctaatcctcatcagatcacatagaaaaatcattgcttaggtaccacattttaggaggggcactgccaagcctgggtaggtgaagacacagcaatgagctcagaagacatccccgacacaggatggctgacagctctggagagaggtgatatgcaattgtagaaagtcatatttcttgcaatcttagaggaataaaggagttttgttgttgtttaggtaaaaagccttcggcctgagctgcctctcccgagctccaattcctcagattcccatttaacatccttgaacttcaatttctttagtaaggaataattatacctcaccatcaggtggttatatcctcacaacaatcaaaagctaagtaagtgtgaattatacaagaggttgaaaaaaccttactagatacctcacgcaatcactggtagaatgatgatcttgtaggggtggtggcaggagggtgggaagacacagacgcatgatgataaggtttggatatttgtctcctccagatctcatgtaagaatgtgatccccaacgttggaagcaaggcctagtatgaggtgtttgggtcatgggggtggatccctcatgaatggcacggtgatgagtgagttctcactctactagttcactcaagagctggttgtttaacagagcctggcacctcttcctctttcttgcccttcctctcacatgtgacatgcctgctctccgtcaccttctgccaggagtaaaagctctctgaggcctctccagaagccaagcagacactcatgccatgcttgtacagcctacagcaccgtgagccaattaaacttcttttcttaataaatcacccagtctcaggtattcctttacaacaatgtaaatggactaagacacatgttaatacagaagactgggagaagccctatcagaagccaacaatgtgccaggagagagggcaaggcagtcccaaccaggagtcaaaagctaatcagtaagctcagtacacacgacagcccgttaatcctcatcaacactttgtaggtaggtattgttgctccatgttactaatgagaaaactgaggcttagaaaaataaaagtctaacagccagtagagaggtagacctcagattttaagaacatacacttgctgtctgccaatccaggaaggactaaactggaaagagctcatcttcgagaacttataatgtataaaacgtcaacctaaatttttttgttgttattaatattttagtgcttagaaaaagaactgttcctacatgaaacagtaattcttacaatattgtttagcaagtaatcttaactttgaacaagaacgtttaaaaataaatatattgttgggtgagcaggaaaatcactttaaaatgttgtagaataatcttccaatattgttcctttcacccatccctcaaactacactaatgaacattttttttctcccagtatttgctctttctcagcaatgcaaacataattttcatgactgttttccattatgacacatactgtacatttccaacgacataaatgacgttcgatgattttttttcccatctctagctctctgctggtcaattagtctatcaactaacacatatttatctcaacatctgagacacataaggagtatcttcattccagatcactgatagtaacctgagaaggaaagaacgacctacaattaacggttcaaactctagcatacaaagttaaaatactgattaaggccagacgtggcagctcccgtgtgtaatcccagaattttgggaggccgaggtagacggatcatttgaggtcaggagtttgagaccagcctggccaacatggtaaaaccccgcctctactaaaaatacaaaaaaaaaaaaaaaaaaaaaaaattagctgggcattgtggcaggcacctgtaatcccagctacttgggaggctgaggcagcagaatcacttgaacctgggaggtggaggttgcagtgagccgagattgcaccactgcaatccagtctgggtgacagagtgagactccatctcaaataaataaataaattaaattaaataccagttaaataccagtacccacacttgagtccacgagtttgaaaccagcctgggcaacacagcatgatcccatctcaaaaaaaaaaaaacaaaaaaaaaaacaaaccagtatccatagttaagtgccagttaaaagacttacatgttcttgaaaatacaaatgaggatgtgaagctgttatctctaaggaaaaccaccaaaattaacagcaaatagccagaaaaccatgtagagaagcatgtaattttgttatggagcagaagacaagggatcattaaagcacttaagctattttataatagactcctcacttacgtttttcgtcatcagcatgcaccagagatgctgccctggacaaaacatccaatggcgtctccattcctggttggagcctaagaggaaaaaataaaaggggaaaaaataatttaaacagaattcaaaagactcttagaatcctagtcattaacagaatgagtcctcaaccaaatgcaaatcattcttctaaggatgaaattcttcccacatgaggaaacagaatgggcttggttcagggagagagaaaagggttaaactccatttagtctactaagctaaactttgccaactacaggaagcagctgatgtaggaactaaaagaagggatattgtgaatattcatgcccatgttatttggtgcttatgtttatgtgcatgcataacatgcctgtataaacatgcccaataaaagaaaggttttcagaacaacggctgctctatgaacacagcatcactaccagtgaggtggtgcagcttaacacacgccacgtactcatggaaagctgtgtgagaaacccactggtaggttaattgatattttaagtccaataagaatctttatgttaaaacgtcatgttttgtataatggtatattatataatcaccacctatcatcaatttatctagcatcatgttttttaataagactggatttttattgttgtttccttaaattacagcatactataaaagctaaaacagcaaaagatttaaagctcgaggaaagccctggaaaaccagaatgctttttacccagtttcccttttctgggttatttaaacacacacacagttactggcacacacaccctactagctcaccagctgagaaaaacaactccttaactgtaccactttacagacacttggaatttattcagcattcttcaacacttatggagtacctactacgtatgcaccggtcacaacatgtggcagaccagcttttctttgtaatattcatacctcaggcctccaaagaaacactgatccacgaggcatggtagctcacgcctgtaatcccagcactttgggaggccaaggcgggcagatcacttgaggtcaggagttcaagactagcctggcgaacatggtgaaaccccatctctattaaaattacaaaaaattaggtcgggcgtggtggctcacgcctgtaatcccagcactttgggaggccgaggcgggcaggtaacctgaggtcgggagtttgagaccagcctgaacaacatggagaaaacccatctctactacaaatacaaaaaaattagccgggtatggtggcccatgcttgtaatcccagctactcaagaggctcaggcaggaagatcgcttgtacccgggaggcagaggttgcggtgagccgagatcgagccattgcactccagcctgggcaacaaaagggaaactccgtctcaaaaaaaaaaaaaaaaaaaaaagaaaaaaagaaaagaaaagaaagaaacatagatccctgatcatgcaatatgacttcattcagtaaacgttaaatatctacaaggagctccaggcgggaaaaataaacaaagcccagtagctgccttcgaggagctttcaatctgcacgggaggcaggccaccgagacatctagtttaaggcagcattcttccaaagcattctgcactgggtgttcatattttgtaagaaaaaaacgtttttctatggtaaataagtttgaggaagcctggagtaaaccaagctaagcagcgtattttcctccccgtgcctttaatctcccgttgtggggacagaaagccctgtacacgcgaaacctcgtagacgtcatgagccattttcaacccaaaacgcatctcagggaacatctggggaaaatactgggttagggcaaaatgtgcaaagcgtcaaaacagtgctagaaacaaagtcctacagaaataacagatgaattctgaaaggctttgtgaagaaaacagaacttgagcggaggctttgaagaacgaatataaaagttcctcccccagaagggaagaacagaagcagaatcggtttaacaacacgctgcccaaatcgcctacaagagtaaaatggggacagaaagtaagcgacaaggttggaaatttagattgggaccacatcgtgaaaggactgagggcttcgatgggaccgcggcttgacacgcattaaggagccactgaaaactccatctaagcagaaaagcggcttagtcatccatgcgttctgggcaagttatcctggccgcaccacgtggaacggagtagatagagctcgggaagctgagcgcagggcggacaacgggaaggccagagccgtgggcaagcacgcggagggcagcgaggggcactggcaccggagccgcggggaggcaggaaaacgcagaggcggagctcactgagcttggcaggcagagagaggaggggagggccacggaagactaagagtggcagggaggcaacgacctcctaacacacgcacatgtcttctttttcagagaggatgggtaaaagcagcggtctaagagggaaaacctaacagtgctcacattcctgatcttctttgtaaaaacagaaaagaccatctcctaagaggaaggatttgtgaacttgttcaacaatggagaaaaccaacaagaacttggaactgactaacagaaaaaagtctgctgaactcccaagaactaggtaatattctcttcacccaagccagcttcctattcaggaaagatctgggtttaaagtcttgtgatttggtcgagaccatcctggctaacacagtgaaaccccgtctctactaaaaacacaaaaaattagccaggcgcggtggcgggcaccgtagtcccagctactggggaggctgaggcaggagaatggcatgaacccgcgaggcggagcttgcagtgagctgagatcgcgccactgcactccagcctgggcgacagagcgagactccgtctcaaaaaaaaaaaaaaaaagatcttgtgatttggggtagtaactgctgataagcatcctactttgcaataatacagcatttagactcataattctctaaattaattttaccccattaagttgaaggacaatgctttcaaaattctagacctaaatagattaatacataccttaggttatataaagtatgcacagaaacaaaatatcaaagcataaaagtatcaaatgacataaggtagacccagaattctagcatagcggaatattagacatttaagtttatacagatgctatgaaatcctaaacccccaagcaacttacattcaaagtaggtagataagataatgggtattaaaggttcatccacaaggcacctgccatctgctgcaaccttattaatgaaatcaaccaatgtttattacacaattattctaagctcagcaaagtgcccagaaaaggttaaggagaaacagaagatagatctctgctttcaaggagtcacgctcttgttcggaaactaaattttataagataggataatgacaggcaaaatcaaaaagaggataaacaaagactaaatattatttaaaactaaaatgggtacagtgtcataaaagagatcaatgtcagctaacgtgtttgccttgtgcacatctattttttgtttgggggtggtttgtggatgcgtgtgtgtttcaaaaagccacttggaaaatttccttccccggttgccctgccccaggcagtcactctcctctctggcctccctcaccttcctggatcgcactgtgtttctgtatacttcctaggtgcaaggaccctgtcttatccccagtgcagtcatcctgagtcaacaacagtctgagaaaaggcacaggggcaggaatgagcacctgggacaggtggccagacctgactagctagaactgaaaatccacgttaggaagcagcagaagctaaattcaggtgagcctgatgcgggtggccttaggaaagagctgacagctggccttcaggttgatacttaatgtcacaggcaacaggcagttgtcatcatctgtccctgagctggcccgtgacatgatgttcacactattttagtttagaagttccatgcgtctaggcatgtggctcacgcctatagtcccagcactttaggaggctgaagcagaataattgcttgagctcagcagttggagaacagcctgggcaacatagtgagaccccatttctaaaaaaaaaaaaaaatttaaataaaaaatgagctggaagtggtggcatgggcctatggtcccagctactcagggagctgaggtgggaggatcacttgaccatggagggttgaggctgcagtgagccgtaattgcaccactgcactccagcctgggcaacagagccagaccctgcctcaaaaaaaaaaaaaaaaaaaaaaaaagacgaagaagttctgtgtaggatggtttgactggagagggtgactccagaagttactggaggtggatgagttaagaggcttctgtaggaagcaggtgcaagataaggacaatacagctgggacatgagggacggggaccaagcattatctagccatggaagaacaaagcaaaggtggaagataacagttattaaaaaaaaaaaaaatggtcttccaggtgggtgtggtggctcagccatgtaatcccagtgctctgagaggccaaggcaggaggatcgcttgagcccgggagttccagaccagcctgagcaacacagaaatttggaaatttactcatttctacaaaagattaaaaaattagccgggcatagggacgtatacctatagtcccagctactcgggaggctgaggtgggaggctcccttgaagccaggaggtcgatgctgcagtgagctatgatcacaccactgcactccagcctgagtgacagggtgagaccccatctgtaaaaaacaaacaaaaagtcttctgcattttatgtcttatatacatcctatccacagcactaaataaacccaataaaacatattgataatgtgggaggaaaaaccatggctacagtattagatggaggatcacaccacattgacaggcaaatcagcatcatgattatttcagcatcaaattagcatcaggattaatatgaatccaggtaaaccacttccaatctatgtaaccctgggaaatgacaacctctgtgtgtctatttcctcatctggaaaatggagatattaatattacctccctcatacggttttctgagaagtgaatgggccttataggtattgaaataattatttgccaaaacttatgcaaatatattgaataaatcacaaatgacagtaaatgtactgaaaatgacagggcactgtccactactttagctagcgtggtctgggaagatttcgctgaagagaagaatggaagttgagacctaaagaatgagaagaattagacccagaaagagcagggagggtgggaaaaggtgggagacagcagcacatgctgagaccaacacacaaaaaagctgggcaggtgatgtggggggcggccagggtggctgccctgaagtcagcaaaagggaggcctgaggtgggcagcacagggccaggtcacgtgtgcctggagggcctgcaacaccgatattttattttaagtccgtgaaaagtcctggaatggcccgaaaagcttcaagcaaggaagtgacaagtttattttatttcctttatgagccacaaattatcctctaccttacacaaaaaattatgctgcatctgaaaaacaaatctaggtctatcccaataatgtcttatttctgtggtagttttgcattaggatatagtgataaccaaaaataatccattgaggaccaggcatggtggctcacacctgtaatcccagcactttgggaggctgaggtgggcagatcacttgagggtgggggttcgagactagcctggacaacatggtgaaactcagtctctactaaaaacacaaaaactagccaggcatggtggtgatggcaccggtaatcccagctactcaggaggctgaggcagaactgcttgaacccgggagacgggggttgcagtgagccgagattgggaaagtgcactccagcctgggcaacagagtaagattccatctcaaaaataataataataataatccattgaaatgctgacacctggaacataacaacatttaagtgagtggagtgtggctctagaaaaagatacagagggccaggtgcagtggctcatgcctgtaatcccagtactttgggaggccaaggtgggcggatcacaaggtcaggagttcaagacgagcctggccaacatagagaaaccccgtctcttctaaaaatataagaaattagccaggcatggtagcaggcacctgtaatcccagctactcgggaggctgaggcaggagaatagcttgaacctgagaggcggaggttgcagtgagccgagattgcaccattgcactccagcccagggaacagtgcaagactccgtctaaaaaaaaaaaaaaaaaaaaaaaaacagatacaaagtacactgtgtgctccactgcactgcaaaccagtttctggtctatctattcacctttttcgtggttgtcaaatgtgaagttaattcatcatgaatagacatatattttgttgttgtggatttttttttttcaggtaatggtcatatattttctctgccagtccacatgcctttcctcacactcccttagcctcaattcatatgttcttccaaataactaaaggttgagaattagggaacaagaggtatcgattttaaagctacaaaaacttaggggcactcagtgctaacggcaagctcagctataaatctgacagccattttttggccttccacaaagaactgtccctttttagtcaacaaggggacatgagtacctatcttggtgtgttagtccattttgtgtcactataaagtaatacctgaggctgcgtaatttataagaaaagaggtttaactggctcacagtagactgtataagcatggtgccagcatctgctcagcttctggtgagacctcaggaagcttccaatcataatggaaggcaaagcagaagccagcacatgacatggcaagggcaggagcaaaagaggcaagaaggtgccacattcttttcaacaaccagatctcccatgaactaccagagaactcacgcatcaccaaggggatggcactaaaccattcatgagggatcgctcccatgatccaacctctcccaccaggacccacctccaacattgaggatcacatttccacataacatttggaggggacaaacatccaaaccaaatcacttgggaacagcactgtggggtatattagattatattgtttttcaagcaatggaacacaactccaaaatatgttatggaagttttccaagaagatttgcacaataaaagctacagcaccaggcatgttcactccatgtctgtcccatggcagtggctagatatgatatactttaggtaagagtacgagaacatggagcaactaccttgtctagatgtggaggccaggggggtgagcatcggaggaatcacattcaaactgccaggtgttcctgccacacacagtaacagggccaaaagtcagaaacagacagacatcactatccttaaacacctgatggcctctccaacttccagatgcacacaataaaataccctaattcctgttggccctgttccttcatgagtccaaactctggcctccccaggaccactccctgagctaaaaccaatttggtttcagctaataatatacaatggtaggacaaacccaaaagtatgaactatcacaccatggcatggggtgtacttcttggccatcaagaatttagagatgtggctgggcaccgtggctcatgcatataattccagcactttgagaggctgaggcaggcagatcacttgaggtcaggagttcgaaaccagtctggccaacatggtgaaaccccgtctctactaaaaatacaaaaattagctgggcgtggtggtgagcacctgtaatcccagctactcaggaggctgaggcaggagaatcactcgaacccgggaggcggagtttgcagtaagctgagatcgcaccatagcactcagcctgagcaacagagtgagactccatctcaaaaaaaaaaaagaatttagaggtggctgggcacaatggctcatgcctgtaattccagcactttgggaggccgaggtgggcagattacctgggcccaggagtttgagaccagcctgggcaacatggcaaaacctcatctcaacaaaaaatacaaaaattggccagtcgtggtggttcacccctgtaatcccagcactttgggaggctgaggcgggcagatcacaaggtaaggagatcgagaccatcccggctaacatggtgaaaccccatcccggctaacatggtgaaaccccatctcgactaaaagtacaaaaaattagccaggcatggtggcaggcacctgtggtcccagctactcgggaggctgaggaggcagaagaatggcgtgaacccgggaggcagagcttgcagtgagccgaggttgcgccactgcaccctagcctgggctccatctcaaaaaaaaaaaaaattagccaggtatggtggcgtatgcctgtagtcccagctacttgggaggctgaggcagaaggatggcttgagcccaggaagctgaagctgcaatgagctgagatcacgccactgtactccagcctgggtgacagagggagaccctgtctcaaaaaaaaaataaaaaagaatttagaggtatttactgggtatctcctctattaaaacactgtatttagacgttacaaaaaaggaaaagtaaactccctgcccttgagcaccgtacaccaaatatggatgatactgggtgatacactggctgtcaggctcagtgagaaggaaaactgaatgagaatcagaccaaatgtcaccagattctggtggcgacatgcaagcacagtttcacggttttaaatcctccagctctttctcctccccagagtgtccggtgatgccccaccaacttcgtgcagcacatattcttcctgttaacatcccattctcaaaccacccctctctgctcttcttgctaaaaatatctctcatttgagtaatccttttttcttctcgcactttaccatctgttaagtcaacagagccaggactttagcatcaggaagcccaagtttgagccctactttaaatctttcactcattcagtcaacaatccctgaaagcctattttgctctaggctttgccctagatgtctaacacttaattgtatgggccagtcatttaccctctccaggccctagtttcctccttaaagaaaaaagtaaaaaacattgcctaactaacttcctatgatcacaagcttatcacatagattaaacgatgtaactgagaatgtcttacaaactaaagagagaaacagattttattagtctaccaccaccatcttccaggtgtatagcatacatgttttcaaaatacattcacataaatgacctgattggattctcacaatcaaattattacttaggccaaatggccaaatatgattattatttttcttctacagattaaaaaaaaagaaaaattgaggcaccaagaatggaagtgacttcctgaagcaactaagactagaattcaagtctctcaattctccctccaatgctatttttactactcttaagttgatcatgctaaagaggttttagtgacaagcacaattatttagcctaggtcaaagcaaaccttccattagcaagcacgacttctagccctgtgctctttcctctacaccttgagatacctatcaggcaataatgtgaccgtttcaacagcgagcaaggggaagcaagcccttacccgtcaggaacacgcaaaccatggtatatttgaaattcttctaacagaggtaggcatggagtcacattaatagtaaccaaggcaggtaagaaaagaagactgtcacaccaggtcaattgatgctgagactgtggccaacaatgacaccggcaacaaactaccaagacatagcgatttctggggccacagccacagaggagtcaagctaaaaccctgaggactttgagatccacgaacaggtacagtagtaggaaggatggtgtcaacttcaccatgctcaggaagacctgtggtcaagctccaacggctaactgttaaggttcagtgagaacatttttaaaatttcaccttggtgctcgaactgctcacaaccttaaattgtatgttacctttctaaatagaagccagcccttattcaaaatattctctcaatagtcatattatcaaagaaagagcatgaccagacggatcatttgctattccagctttcctcacagaggcatgtcccaagcaggtataactgactcacgctgccgtaatttgaagcatcaatgccagaagaacttggctgcttctgcttgcgtcaaattccttacttctacacatgatcactcctgaaaattcattagaaggccaaacgttctaatatttgaacaatatatcttcatgttctatatctacctcctgagaactgtgtgtatatatattatttatatatatatatatatatatatctgcataaaatccctaattaggattttttcaggtacctgccaacctcaagtgtgagccccagatcacaccctttccataaggcttagcacccctcctgtgaaacctctgcaggagggaggtctacaggctgggcagctgtcaatctcttaccctccaatgtaggctggaggctgtatagcaggaacaggtaaccttaggtgcctccacctcccatgacctcaacagaaagtgagacccccattaactcagaccaaataaagggctaacactctggatggaaacactgaatgaatgctctgctcaaccactcaaggtttcctgatgctaacgtggctcagggcttgagtctataggacttctcagccctgcaggagggcaggggtacgatacttagtcatcacaactaccctggcaacaggagctagcagatagtgccaccacacagtgacaaaaatcctcggttattgtaatacagtttggtatcagtgtaaactatacaaatgcacagactgtatgaaagttgatcatgtacccggtgaggtacatctatacaggctctgggctgcaaaacccaacttacattacaacacatttcacggccctatgcaatgctgcctgatgctggtgcaaaattcttactgctggctgaagtccacccatctccctaaagtgtcccatggaaagtgactatatggtgggcccacactgaaactactgttatctaagggggacaaataaaaatcaagtctgaactttctgagcagactaccaattcccaacatttttcaacactgttgtcagcacaaataaaaatgaggccaggcacggtggctcacacctgtaatcccagcactttgggaggccaaggcaggtggatcgcttgaggccagaggttcgagtccagactggcctacatggtgaaatcccatttctactaaaaatacaaaaaataaaataaaataaataaataaaaatacaaaaaaaaaaagaaaaaaatgaaccatgtttttctttctcattttaggatattatgaatctctctctcttcattttcaagaccgcagccttatacagcaaggcatatgaaataacagaaactctttggcatttttagtttcctctggatatgcttgctcttgcatttatttgaagacttaaaatttgaatacttatgtgaatagttagtatttcctattcacaagtgctaaagcgacacatattcttagggacctattactcccaagaataaaagatgaatttgggctgggcgcagtggctcacgcctgtaaccccagcagtttgggaggctgaggcgggcggatcacgaggtcaggagatcgagaccatcctggctaacacagtgaaaccccgtctctattaaaaatacaaaaaattagccaggcacggtggcgggcgcctgtagtcccagctactcgagaggctgaggcaggagaatggcgtgaactcgggaggcggagcttgcagtgagccgagatcgcgccgctgcactccagcctgggtgacagagcgagactccgtctcaaaaaaaaaaaaaaaaaagatgaatttgcatcacagcccaagttagcaagcttcccagaacagcccaggtctaactctccatggttccaaaataaaatctcagccctcagcctattaaagccacataaagtcatctaattaatgacacagtgcaacattaggtagcactgtagttattaccatcagtaaatattattggttcttttttttattttttgagatggagccttgatctgtcgcctaggctggagtgcaatggtgcgatctcagctcactgcaacctccactttccgggttcaagcaattctcctgattcagcctccctagtagttgggatcacaggtgcccaccaccatgcccagctaatttttgtatttttagtagagacggggtttcaccatgttggccaggctggtctcaaactcctgacctcaggtgatccacctgcctcggcctcccaaagtgctgggattataggtgtgagccaccgggcccggcccagttcttgttattcatagtagttgtgttctgtaaaatctctgtgaacattgaattagtggatattgaaccagtgttcctaggggaaatgagagtgagattccttccggcttctggtcacatttttgcaaactgatcaatacacaaccttgttttacgtatgtttctgtttaaagacaccttatttaatacctattgttgattcattaatgttgaactcaaggccaacagcaccgtaactcaagcctgaatgaagctcatctaacatgtatattttctccatgaggctcatcacagccttcttggctgaggaacattagacagcattttagcaccatacttacgggccactgtaaatagcaaaatccccaataaaaagcacaaaaatgggcagggtgcagtggctcacacctgtaatcccagcactttgggaggccgaggcaggcagatcacgaggtcaggagttcaagaccagcttggccaacatggtgaagccccgtatctactaaaaatacaaaaattagccaggtgtggtggtgggtgcctgtaatcccagctactcgggaggctgaggcaggagaatcacttgaaaccggaaggtggaagttgcagtgagctgagatcgcgccactgcactccagcctgggcaacaagagtgaaactctgtctcaaaaaaaaaaaaaaaaaagcacaaaaatatataaaaacatgttactaaatagactgcaaaaagcacacttgtttacagcatgagagctcaaacaagaaggcagggtagtgccttgtctgagctctactgggaacatgtgcattgggaggctcaaatttttccccatactgcacatgtccacaaatgtcgaagaaagtgtcagaggcattgatttggggcttacaaataaattttagtgagtagacaaatttataaacatggaaccacgaaaaatgaggatcgactatatctggctattagacctgaggcatgagacacagaaagtacattctacaaagttttctctctttgcaaaagtgctattattctgtatttcaagaaggtataattgttctggttttagcacctcctacattccttttcctaccttggcagtttgtatctgccaaatcttgcatcaagattttgcaatctagttcttatgatactgggtttttttttgcgggggggtggtttatgtggacagatcctaaatgctacagattagcagcattcactttactcttctattaaacacccacccatagcttcattaactttaggtgagttccctgaaagaagcacaaatgagcctcagttaacatacctcgaagaaatttcttaactcacacacacaaaaaactttctctttcaccaggttctcatagctgcaacagctcatctcacacaagcaataagcagacacattggtatgttaaaatcaccacaccaaaacaagaaggcaataccctgccttcttgtttgagctctcatgctgtaaacaactgtgctttttgcagtctatttagtaacatgtttttatatatttttgtgctttttttttttttgagacggagtttcacaatttcagtgacgttaaaattttcccgtgtattttatttttccttcctgagcttacaacttttagtacttttgttaggtcatgttcaaagttacaaaacaacttttattgttaacctactcattattttactaaggcaaattaaaagctgcacagcaaaactctccaagacagatacctagaagagacacgaaataaactctccctttggatttgttttggcaaccaccagagactggtaacagggctgcctccataaggagttaagaggaatttcccactacagattttttttttttttttttttttttggtacagttgggagccgggagtctctctgttgtccaggctggtctggaactcctggcctcaagcgatcctcttatctcagcctcccaaagttctgggattacataggtgaaacaccgcgcccggcccagaacatttaaaagtgaaagtttttacataattatcatgtctgtaagaagtgttaaaatcttcagataaagtcataattttaaatcagttgggggatagcagtaacaactgtgtttatgtagctctttcaaagcttcaaagaatttataaataacacaaaatactttcaaagcacattattctctgtaattcctgaaactctgtgatgtattggaactaatattaccacccttttacaaaggaaaataagatacaaagtttgagtacgagtaacatttctggtcataaatctagtcagtgacactgataggactagaactcaagtctccagaaataataacccagagctgtttttactacaacattcacagttttggaatgtagtccatagttatttatagcagaattatcttcttaattgtattgtgttttggtcaacataaaaattagtttgcattcacttccaaatggaaagcaaaggcaggctgcccagaagtgtgaaaaaacggtggccggggaaattagcctgggattaaaattttgccaaagttaaacaacgaattgaagggtttacatcatttccaccgtgggggagatgacttttcaggccagatgtaacaggaaatacaagaaaaaattcaaaactgtcttgagtgtaagacaagaaacttctgaatcaagtatttctaaatcctttatttaaattgagagcattgggacttagagataataaataacttgtcccaagatcacaccacagggacagctttactgctccgaccccaaaggtctccttaaactgcccactctactccctcccagtcatgcgcagactcttcattagatgcaagcaggaaacaatgaacagtacaagtccgtggactcagcgagtagagaaagagttaaagtttggtatgctaacatggtatgcaaaactgaccttcaaatcctaataggcaaattaattttttttttgtctttgactatttagaggaaacaactgccagactccttctgagtagaggtaggcttgggtatagaacaagatattaaaactccacaaactgggagacagtgcctttcaaagagagggcaaccagctgttgataaaacccagcagaaccgcctccacttccccacacccctaccctcccgcgccaggctgctggttcttattaatcacagagaagggactacaactagcaaacatacagcaccgacgatcaaagtgaaaccgattttttaatcatctaacttaaacagacgaacacatgccagcaacgtacataaatacgaatagccccagcaagcactgtcttcataacctaagacagttaaatgtctcagggtgatgaatcaaaggagacttcaagcaaaacaaaaagcgaacagccctgtgctcttccgcgaggcctgcactgggtgcagggagagtgtgcagtcctgttttggggaccgggcaggaagcacaggaagagtacggtgccccttcccgcagtccacatcacagccctccctgaggccggcggggaccgcggggtgccaggcgcgggcctcctcgcccgccccgagcctccgactcccaggacgtcctccgggagcctaggcgcttccgctcccaccggcgcctcccgagcggcccggcaaggacccgccacctcctccctcccgcagggcatcccggttctgctccgacagcccaccccaaggcccctctcaggccagccctcgcccagcccgggtcccgccccgccgaccgggtcaaccgcactcaccgcccggcggctctgggcgcgcccgcctggggccggcctggccctgcgggggacccaggggcggggacgggacctgggcacgcggggcgcaccccgagggcgcgcagacgcacaggcgggctcgcgcccgagcccccgcacgggcccccgccaaacacgcacacgcacacgcacgcgcggaccgggccggcggacgggagcgcgggagcgcgaggaatccctggaatgaggcaccggccaacctgagccgggctccgccaggccagccaggccacgccctcggtcacgcccctcacggagcaggtgggggctgagccaggtgagccgggagggagataggggcgaggcctcccgcggcagggagaggccgctttccctcccccgccagctgcgcgcccggtgccagctcgcacctcccgggccgatgccggcgcgctggggcagtgaggtttgtcggggcgggcgctcccgagaggcgccagcgggcagggcgagtggacatggcgcacactgctgtggacacggcatctcgcacgcccccgcccccgaggccccgccaggggacacagcgccgtgcaaatgtacaaacacaaacgcacatttcgtgcgcgcccaggtgcccgccgcgctccccacgcgcgcacagtaggtccctgctcccgggggacagcgcacgggacgccgacgttcacagtccaaccagacccgtcccgcggacctgctgcccttcccgccacacacaccccgccaagcgcccggagttcagccgaacctgcggcacccacgccgccctccgcttcccccggctcgcgagcagccggataagggcgcaccacccgcccgcgccggttcgccgtccacacccgctcacccccggaacgcggcgcaccttccgtcccccgcctcccgggccccgtcgccccctctcggcacccgcatgcccgagccgcgctccccgacggccgacggccacgcacctgaagggacaggtcacaccggctgcgggaggggctgctcggcgccactgcgctcagaacggccgcggcggtcccgggcgctccgacgccgctgggtttcctcccattacagcatgttgcactccagcgctgcacttcacactcgcacacgcgcacacgcacacgcgcacaactccaggcgctcggcggcgtccttcccccgcctcgcccggaggaggaagtcctagtaaatcaaaacaggctgggagggagggagatcggagtggaaagagtccccttcagccgctcacacaccagtgtttgctgtgtttggcaaactcctggcgtccacaacccggactgctctgaaatgt

SEQ ID NO: 2249 - DNA, 56435 bp, Homo sapiens
ctgtcaaaaaggatcaaacactttattcatctacacataacatatataaaagcaagcaaaatcaggatgttttcctcagccaccctttccacattttgtgcagttttagtgaactataaatcactgacttcttcaggcctaaaagagaaaagatgagaaagtaagaagatggaggcttgttgagtggatgctcagagtttcagtgacattctgagcagacttgtctttggaggagggcagtgaggggctgacccgtggctctaggagaccagggagctgaaggtgattaaaggtcactgtgatcaatgtagggggaaatgattctgatttcggcattttccgatttagggctatggatgccaacggttcctaagttattgggataagtgatccttttgagttatgaacatattggcagcctctgaatttagctctttcaaaaaggtaggacaaggataagactctgtatgccactgggtccccgttctctcaggcctaaattccaaccccacctcactgtctctatgtcactgtgaaaggcacctgtctgactatgacaaatgctgttcccatcactttctgcctcgttgacttggaatccctgtttggatttcttctctaggaagtgcttccctggacccacagggtggccccacagcatctgtgctcactcaacacactgtgcagtacgtgtgggccgattcacccacgcctctgcctggactgggagcttcctgaggacagggaccttgccctgttcacctaggtggccctgtcacctagtacaggacccagaacacagcaggtgctctgtgaaagcttttgaaatgacaagacaaatgtgcctcattcggagagctggccccctagcacccccatctacttagtcaggagtgtgtgatgaaactggagaaaggctctccgggggcttaggggaaagaagaaaaagggaataaaataaatgggtgttatttgtcagatctaagagtatcctatctgtggatgcgattatggactcaacttcctttgtgttgagggtgggatcattcagtttgtgtttcagggtgtggcccaaagatatgaacagtctttttcactgtgagacacaaactgtgatctgtgctatgagtgtaaagtgcacacccctggcagtgcactttggtgagcatgccgacaaggtaacaggtttcgctctggacatgcctagcactggggtttgagtgatggcttgaaaatatctggccctgttacctgtaaactgcttagtccacttagagccttggaaaagaccactgcagacagtggcaggggagcagtaaaatcattaatgaatacttccagacactctggcttcgtttgtctaccagctgactacttgcaaaccaacataacctagtcaacaaactcagagttcctttccctgcctccaccccttttaattttctccctggagcaaccactctggtaaaccccacccacttcagcattgagactagaagcttattatataaggtggtttttaaaattccagccagaaccaaccaaaagaccaagccgaatacaggtagttatacatggaaaggttcatatagcaaccccagggcactgagtcacagctagaggaggatgcatgggccatgataattcccagctcaacttcaaaaagcagttcctggatcttaaacatttaaggtaaatacataaagtagaagagtgtcaccatgtagccattttttttttttgttgctgctagtggacagaaatctcccttgactaaaacattctccctttcatggttctgccagtgagacattttcagaaagactgcagcagggaaatctgttagaaagagcactagaatcggagtcaagagacctggactctagttccaggtgggccacaaactaacagtggcctttccctgggcctcaatttccttatctgtaaaatgactgggttggaatagatgaggggttctctaacaaggggtccacagattaagtctgagtgtctgtgaactccctaacactgcaggaaaatctactgtgtgtgtgcgtaggtgcacttctgtgcagggcgtccagagttctagtcagattttcacagggatcctggacttgcaaaaggctaagaaccaacagatcagaatgaagagtcttttctgccttaatattataatttcaacagaggtggagaacttaaatttcatgattttggaataggcaaaaattttctaaacaggacacaaaaaactgctaaacatatagaaaacaaaatggataaactggactacatgaaattatgaacttcttttcaccaaaagacaccattaagagagtgaaatgacatggcttacagccataatcccaacacttagggaggccgaggcgggcagaccatgaggtcaggagatcaagaccaacctggccaacatggtgaaaccccgtctctactaaaaatacaaaaaattagccaggcgtggtggcatgtgcctgtagtcccagctacttaggaggctgggacaggggaatcgcttgagcccgggaagcggaggttgcaatgagccgagatcacgccactgcactccagcctggccacagagcaaggccccatctcaaaaaaaaaaaaaaaaaaaaaaaaagagagtgaaatgacaagccacggagtgggggattttgacatcacatgtatccaacaatggagttgtgccccgactacagagagaattcagtaagcaaaagagacaactcagtaggaaaatgagcagaagactagaatagacgcttcacaaaagagcatatccaaataaacaaatgaaaaatgctcaacttcctcagtcatgaggaaaatgtaaattaaaagatcaatatggtaccactagtcacccactagagtgcctaaaatgaaaaagacctaaacaggcattcagggaggtgctgcaacagaagctctgctagtgcaagtataaatgtggacgattgtttagcagtttctactaaagctgaacagtcacatgctttatcatccaggtattctacccctcagtacatacctgacaggaatgcatacacccacccaccaaaagacaggtacaaaaatattcacagcagcactacttctaatagtcccaagcgggaacaacccaagtatccatcaatagtagaatggatacattgcggtatattcacacagcagaatactgcactgggcagaaatgaaccactgctactcccaacacgatgaatctccctatgttataaatgaacagggaaaggcacaaaagaggacatgcttatacatggttaaaaaatgggtaaaacagaaccgtggcactgggagtcaggctggagcttactctcggagaagcaatgcctgtgacgggcatgaggggtactggggactggaatgactgtatttctttacctgggcactaggtctatgaggtgttccctttgtggaaattcatcagatttatgatttttgcacttttctatctatatggagatatttcctactaccagaaaatttagaatctttcatttatttggtcacacatagaacaaatatttattgagcacctgtataagcaagacactgaactagttgctagggatactggtacagataacagctatggtctctgccctcacagagtccacaatccatagacttctacttggtctacactaagcttactttcttcaatttttttttttttttttttactctgtcgcccaggttggagtgcagtggcataatcaaagctcactggagcctcgatcttctgggctcaagagatcctctctcctcatcttcctgagtagctggggctacaggtacatgccaccacgcccggctaattttattttatttttgtagagatggggtcttgctttgttgcccaggctggtcttgaacccttggcctcaagccatcctcccaccttagcctcccaaagtgctaggattacaggtgtgagcctctgtgcccagattacattaagcttactctttctacaggaaaggatgatgatttaggaattctgctcactccttccccagtggataaaaatgcaacatctctttagatgcattccctgtagagagatccttatttacctaaagctagtcattatgaattctggttagaatctaaagtcaggattttgttttagaagcatgcagaaagctatgtcactatatggctccttaggtttctcttctgatttccagcttgtttcacatgacctacagcgaagttaatacacacgtaagactatgaactccccgtgtgatcttaaaacagatgggctactgacagacaaactctccaggaaacaatgtgaggtagaaatatggctaggctgtgaaagatctctatctttccataatcttacgtttcagacctttgataaaattagtatccccaaaacatccttccagttcatttccaaccataagcagatatatcgacaaagaaaatctcttctgaggcaaaagtacaacttattttaagaactcacaggcttaagtgataagcaaatcagcaacagagcaccagtgttcttctaatttaaatatatagataccaacaaatggaagaaatgcttcagttttaagaaatcagaagcagaggataatgactaatccattctactgtgttcccggaaaaggctggtaaggatcaactgaggcatgccttttaggagcaagactgaacctgtcttgttaatttagtttagttgaatcttttgaagctagagaggtaaacaggtatttgtccccagagttaattctgattgaccacaaagtcaggtgggaaaaaataggatttaaaaattaaactcatcatcctcgcccaacctccccctctgctcagggaatgaatggctctactgcttcccaggccaaaaacctgggagttagttctgactcctccttcatgtcccatatccctttagtcaccaagacccagtcgttcccttctaaacacggcaaatctttcctgtctgaactgcaatgacctgagttcaggctgctgtaactcctcagctgactggctgtagccatatctatttggtctccctcgcaataggtttactgcccttccatttgatctctatgctctaactacggtagtctttcggcagtcctatggtgacttccctctgccctcaaaagaaaccctgaactccttaacatggcttttaaagtctttgtttggcccctgcttatctctccatctgatcactaaactcccccatttctcatctacctattcccacaccagagtactcagacagttccccttctctccactcgcgttagaaactttataaaaggctgctgctcgaatatgcagttgcttagctggtcttttgttgccagtttgagatgtgaggtcatctgctgctaccatgaaaggaagagcaggcaaattttaggaggctaaatagtcttttggtactcctaagccagctggcttcagttgctgatctgatgagaatgatgttattctactagcagcacagtctaagggaaattaaaacgatttgctaaataatcaactcccaggctaaaggaaaaggaaaacagtgtttggttttggaagcaattctctaatcacatttgaacatgagtgtatgtgatggtcagggaatttcaagggaactaataaagacaaagcatcagtgagactgcattgaggacatactgccatgttatccaacagtgtttactaggaagggcagtcctccgagctggttatagatgcctggcttccatcttttgtaggagtagagtgaaatttagatctacattcatctaaatttataaagcacctctggataacaccctggacgctctcatgtaagcctcagaacaccttgtgagttgggtattagtattcccaccacctcacagaagagagaataacataccatagtcatagagtgaagaaatgaataattcagaaccccaaaaccctatcctctgaccccaagcttagctccttcactaagcggattcccggaatttaactgaatttgacctttgtattggctggctaaggggaagaccaaatcttcctttttatcccatttatgagtaggaggttgcacaggggaggaggggtaatggctacaaaagaataaaaagtaaaccaaatatgctagggttttctcatcctacagatgacatacgagctggctgaaaaactgaacagaggcagaacttgagaaattttggggagaaggacctaaaaaagtaaggcagaacaacaacagctatgatgacaacaaaaggactcataaagaacaaggtggatctcagctcaaaagctccttcagctgataaacaacttcagtaaagtctcaggatacaaaaatcaatgtgcaaaaatcaccagcattccaatacaacaacaacagtcaagccaagagccaattaagaacgcaaccccattcacaactgccataaaaaggaatacatctaaccagggaggtgaaagatctctacaaggagaactacaaaacactgctcaaagaaatcagagatgacacaaacaaatggaaaactttcccatgttcatagatagaaagaaccaatactgttaaaatggtcatagtgcctaaagcaatttatatattcaaggctattcctattaaactaccaatgacattcttcacagaactagaaaaaaactattttaaaattcatatggaaccaaaagagcccgaatagccaaggcaacactaagcaaaaagaacaaagctggaggcctcatgctacccgacttcaaactataaatacagggctacagtaaccaaaacagcatggtgctggtacaaaaacagacacatagaccaatggaacagaacagagaacccggaaataaggctgcacacctacaactatctgatctttgacaaagtaggcagaaacaagcaatggggaaagaactccctattcaataaatggtgctgggaaaactggttagccatatgctgaagatcgaaactggacccttcctcataccatatacaaaaattaagtcaagatggattaaagacttaattgcaaagctataaaaaccctggaagacaacttaggcaataccattctggacataagaatgggcaaacatttcctgacaaagatgccaaaagcaattacaacaaaagcaaaaattttaaatgggatctaattaaactaaagagcttctgcgcagcaaaagaacaagacagtgaagaacagagtgaacagacaacctaggaaatgggagaaaattttgcaaactaggcatctgacaaaggctttatgtccagcatctataaagaacctaaacaaatttacaagaaaaaaaacaaacagccccattacaaagtgggcaaaggacatgaacagacacttttcaaaggaagacatacatgcagccaacaatcaaaggaaaaaaagctcaacatgactgactgataattagaggaatgcaaatcaaaatcacaatgagattccatctcacagcagtcagaatggttgtcattaagtcaagaaacaacagaagctggtgaggttgtggagaaaaaggaacatttatacactgctggcaggggtgtaaattagttcaaccactgtggaagacaatgtgccgattcctcaaaaacctaaaaagagaactgccatttgacccagcaagcctattactggagtacatacccaaaggaatataattcattatatcacaaggacacatgcatatgtatactcattgcagcattattcacaatagcaaagacatggaatcaacctaaatgcccatcaatcgtagactgcataaagaaaacgtggtacatatacaccatggaatactatgcagccataataaaaaagagaccatgtcctttgcagggatatagatggagctggaggccattatcctcagcaaactaacacagcaacagaaaaccaaatgctgcatattctcacttacaagtaggagttaaatgatgagaacacacaggacacatagaagggaacaacagacactggggcatactgatgggtgaaggatgggaggggtgagaggatcaggaaaaataactaatgggttctaactaggcttaataaataggtgacaaaataatctgtgtaacaaacttctatggcacaagtttacctgcataacaaacttgcacatgtaccccaaacttaaaataaaagttaaaaaaaaagaacaaggtggagaaggatagaggttctgaaacttactgtgaggatgaggaaagagaaacaggcaaaccagtcactcggtgcctgtcactgttagtttactccagctggagacctgggccaggggctaacactattcaaatatgacattgtaaagaggcttgttttaaagagaggtcaggaaacttttaggtaatgataccaaaagaagaaaaaccagacacaatgctagatgccttaatatatcttaaaatataatctcctggccaggtgcagtggcttaaccctataattccagcactttgggaggctgaggtgggaggatcacttgagcccaggagtttgaaacaagcctgggcaacatagtgggactccatctctacaaaaaacaaaaacaaaacaaaaaaacagccaggtgtggtattgcatcctttagacccaggtacttgggaggctaaagtgggaggatcacatcattgtactctagcctgggctagaacctgtctccaaaaaaacaaaacaaaaacaaaaaaacaaacgtaaaatacaccattgcactctggcctgagctagaacctgtctccaaaaaaacaaaacccaaaacaaacaaaaaaccaaacataatcttcacaacctggtgaggcaggcataattattcctatgaagttaaaactcagaaaaattaggtaacttgcccaagtcacactggttaggttgtaatttgagctctagtctctgcggctcacaaacctctgccctcagcactatgctaggaaacctttgtcacagcccttggccataataaacagagcagccagagcataaggccatttaacccacagaatctgaaggggtgctcatcactttccatgctttatgtcacctcagtgtgaggtaacatacattctgtcactctggacttccacaatgcaatgtggcatcattagaagtgaagaaaaggctgtgcaggaagagaggttaaaatgtttagaaaaatttatttaaggaaataatcaatgaaagcttcccaagtctagcaagtgtgtcagatatccagatacaagagacccaatgacccccaggtgaatacactgcaaaaaggacttcaacatagcatactataatcagaaggtctaaagtgaaagtaaaagaaacaattttaaaataagcaagagaaaagcatctagtcacccataaaggaaacctcatcagactaacagtggacttttcagcagaaaccttaaaggccagaagagaatgggatagcatttttaaagtgctgaaggaaaaaaaccctgtcacccaagaattttatatcctgctagaataagcttcataaatgaaagagactagtctttcctagacaaatactaatggaatctgtcaccactagaccagccctataggaaatgctcaaaggagtcttaaacatggaaacaaaacgctgatattcaccatcacaaaaatacccagaaatataaaactcacagttcttataaaacaatctcacaaaagaggaaaagaaagaaatcaaattacagaatttcatcaaaacacaaggacaaaaagagaaaaagaaagaaaacaaagaatttataaaataacttgaaaataaccatgtgacagaaacaaaacctcacatatcaatattaactttaaatgtaaatgcattaaatgcttcatttaaaagatacagactggcagaatggattaaaaaaacataatccacctatatgctacctacaagaaactcaccttacctgtgaagacacaaatagactgaaagtaaaggggtggaaaaagatattccatccaaaaagaaatcaaaaggagaactatatatatgtcaaataaaacagactctaaatcaaaaacagttaaaaaaaaaaaaaaagactaagaaggtcattatataatgataaagggatcagttcaccaaaagggtacagcaaatcctaaatatatatgcacccaacataggaccacccaaattcacaaaacaaatattactagctctaaagaaagagatagatagcaacacaataacagtgggggacttcgacattctactcacagcactatacagaccatcgaggcaaaaaattaacaaagaaacactggactttagaccaaatagacttaacagacatttacagaacattcttcccaacatctacagaatatatgttcttttcatcagcacataaaacattcttcaagcatgggctacatagggagactttgtctctacaaaaaataagattaaaaataaatgtagccaggcatggtggtatgtgcctgtggtcccagctactcaggaggctgaggtgagaggactgcttaaccttaggaggtcaaggctacagtaagccatgatcacaccactgcactccaccctgggcaacagagcaagaccctgtctcaagaaagaaaaaaaaaaaaaaggaagaagaaacattcttaaagatagatcacacatcacacattaggctacaaaacaagtcttaacaaattttaaaaaatcaaaatcaagtatcttctcagacaatagtagaataaagctagaaatcaacataagaggaacttcagaaatgatacaagtacatggaaattaaacagcatgcccctaaataatcacttaatcactgggttaatgaagatttttttcccctgagacccctgagacagggtcttactgtgtcacccaggctgtggtgtaatcatggctcaccgtagcctcaaactcctttggctcaagtgagactcctgcctcagcctcctgagtagctgggactacaggcacataccaccatgcacagctgcacagctaatttttttgtagaaatggggtttttccacgttgcccaggctggtttcaaactcctaggctcaagcaatccacccacctcagactcccaaagtgctgggattacaggcatgagccaccatgcctgaccttaaaaatttttggaaacaaataaaaatgaaaacacaacataccaaagcctgtgggatgcagcaaaagcagtgctaagagggcattactaatgtttacagcattacatgtctacataaaaaagtaggaagatcacaaattaacaacctaatgccatacctcaaggcattgaaaaatataacgaaaactataacaagaaaaaaaataactaaactcaaagttagcagaagaaaagaaataacaaagatcagagcagaactaaataaaatggagaccaaaaaacaatacaaagtatcaacaaaatgaaaagttgggactaggtgcagtggctcatgcctgtaatccctgcactttgggaggctgaggctggcggatcgagattctaggagttcaagaccagccagggcaatgtggcaaaatctcaccttgacaaaaaatacaaaagttagccaggcatggtagtgtgcactgtagtcccacctacttgaaaggctgaggtgggaggattgcttaagcctgggaggcaaatattctagtaagccatgattgtgccactgcaccgtgtagcctgagtgatagagccagaccctgactcaaaaaacaaaaaagaaaagttggttctttgaaagatacacaaaattgataaaccactagctaagactaagaagacaagagagatacaaataaacaagatacaagacaagaagagatacaaataaacacaatcagaaatgaaaaaggagacattacaactgataccacagacatacagaagatcatcagagactattataaacaactagatgtccacaaactagaaaacccagaggaaactgataaattcatggaaacataatcttcaagattgaaccaggaagaaacagagtatctgaaaagatcagtaatgtagtagcaagactgaatcactaataaaaatctcccaagaacaaaaagaagcccaggacctgatggagtcacagctgaactctaccaaacacagaaagaatgaataccaatccttctgaaactattctaaaaagatcaaggagggaattctccctaactcattctatgaggccgctatcaccttggtaccaaacagacaaggacacaacaccaccaaaaaagaaaattatagaccaatatccctgatgaacacagacacaaaaatcctcaacaaaatactagcaaattaaatccaacagcacatcaaaaagagaatacattatgatcaggtgggatttatcccagggatgcaaggatggttcaatatatacaaatcaataaatgtgatacatcacataaacagaattaaggacaaaaaccacatgattgtctaaatagatgcagaaaaagcattcaatagcctgggcacagtgacttatacctgtaatcccagcactttgggaggccaaggtgggcagatcacttgagatcaggaattcaaggccagcctggccaacatggtgaaactccgattttactaaaaatacaaaaattagccaggcatggtgatgcatgcctgtagtcccagctactcgggaggctgaggcagtagaattgcttgaacccaggaggcagaggttgctgcgagctgagattgcaccactgcactctagcctgggtgacagagattccgtctccagctactcaggaggctgaagggggagaatcgcttgaaaccaggaggtggaggttgcagtgaggtgagatcgcgccactatactccagcctgagcaacagagtgaggcagttgctctgtctcacaaaaaaaaacaaaaaacaaaaaacagatgttggtgcagatgtggagaaaagggaatgcttatacactgttgaagggaatctaaattagtatagcctttatgggaaacagtatggagatttcttaaagacctaaaaatagaattaacctttgatctagcaatcccattactatgtatacatccaaaaggaaagaaatcattatatcaaaaacaaaaacaaaaaaaaccactcgtatgtttactgcagcactagtcacaatagcaatgatatggaattaaccaaagtgtccatcaatggaggactggataacaaaaatgtgtatatatctacatctatatctcaccttgaatactacttagccataacaaagaatgaaataatgtcttttgcagcaagatggatagaactggaggccacgtgtataagtgaaataactcagaaacagaaattcaagtatcacatgttctcactttaagtgggagctaaacaatgtgtatgcatgagcatacagaatagaatgacactggtgactataaaaagtgtgagggtgggaggagatgagggttggaaaattacctattgggtacaatattcactatttgggtgatgatgggtacactaaaagcccagacttcaccatgtaagaaaaatgcacttgtattccttaaacgttttaaaaattaaaaagaaaaaaaagtgaaggggaagcaagcagtaagcactcaggggaagcagcatcagcactccagggccacaaggacagctgagctgtgggttctgtgatcaactgccctctgctggtgagtagaaataatgagtggaaagaggaccaaaggctcatttcaggttgaaggtgtcaagaagatctttttcagccttttattagagaaaaattcaaacttaaataacagacagaagagtataaaacagccccatgcatctttacctagctttgacaatatatcagctcatggccaatcttgtgtcatctacccattacccactgccctctgccatgttttattttgaagcaaatcccagacaacatatcattgcatctggaattattttagtatgcatctctaaaagaaagggaattttttaaaaagctccataacaccaccattgtcacaactgaaaaataattaacaataattctaataattccaataattccttatagcatgggacgccaacaacaaaacaaatcattaagcctcacccaaggaggatcatggcaagggaaaggcaatcatgcaaaattcagattaacagcatgaatcacccaaacaaacaaaagtacctcatcttcagtcttgccagagtaaactagcaggaacatagattaaatgaatatcttaactggaaatgcaaagccatgcacccaaatggtaggaaaatctttagttcagcagatgtgacacaagtgctactaagtctttgttgaaacttttatacaatgtttttattattataattttttttttttttgagacagggtctcactctgtcacccagactgaagtgcagtggtgcgttcttagctcaatgccgcctcgacttcctgggctcaggactacgggcgcgcaccaccacgcccagcccttttttttttttttttttttttttttttgagacgaagtctcactctcgcccaggccagaggcagtggcacaatcttggctcactgcaacttccgcctcccaggttcaagcaattctcctgcctcagccgctcaaaggtgggactacaggcatgtgccaccacgcccagctaattttttgtattttagtagagacggggtttcaccatgttgcccaggctggtctcaaacccctgagctcgggcaatctgcctgtctcggcctcccaaagtactaggattacaggcatgagtcaccacatccagcctattttttctatttttttagagacagggttccaccatgttgcccaggctgatctcaaactccaggactcaagtgatcctcctgccttggcctcccaaagtgctgggattataggtgtgagccaccgcatctggcctatttttgttatttttaaagagacagggtcttgctgtgttgcccagactggtcttgaactcttgagcccaagcaatcctcccgccctggcctcccaaagtgctgggattataagtgtgagccaccatgcctggccttgttgaatctttccagtgattcaggagggcaacacggtccttgagggccaaatgctcagaggagtatccaagcagctgggctatgagacactgagaggtgtgaccataccagctccccagcaatctcaaacccagggattagaattaggttgaaagatcactcccctttttgggctacctctgtgctatttctccctctcttgcaaatttctgttagcatgtctcttttcccttctaaattatacgcctctgcaagtcagtatagcatttgatatggtttggctctgtgttcccacccaaatcttaccctgaattgtaataatccccacgtcgtgggagggacctggtgggaggtaattgaatcacgaaggcaggtctttcctgtgctgttttcataatagtgaataagtgttacgagatctgatggttctataaaagggagctcccctgcacatgctctcttgcctgccgccatgtaagacatgattttgctcctcattcaccttccgccatgattctgagacacccccagccatgtggaactgctaatcaattaaacctctttcctttataaattacccagtctgaggtatgtctttattagcagcatgagaacagactaacgcagcgttgtgttcacttttgtatcccgagcagctggcacatgagagatgctcaatggatgcttgcatgaagaaagcctgaactagaaaagtctatcacttgatgatgccaaatgttggaaaaaatgggaagaaaagagtattctcctactctgcttgtgggacgatgaactgatacagccactttgtcctccaaagagatgtcaaatatttaggccataaaacaagaataggatgcaaaaaacaggagcattcagagaacagcaagaaaagagagagttcctggaaattataaacactcaacagaagggttggaagctaaagttgagaaattcgagaaaatcttccaaagcagagcaaaagaaaaacagataaaaaatagaagacaaaagaaagaaaaccaaagactaatctagggggtgcaatatctgaataaaaggagttccagaaagagaacagagaaaacagatgggacaaaattaaagaaaaaatttaaaacatttttcttatatgcttatattctgagtttcccaacagaaagggcaatgaattcccggtaaaacagataaaacagataaaaacagactcacatcaaagcacatcactgagagaattcagagcactggggaaaaataaagacctaacatgcttccagaaataacatacacaaaggattaagaatcagattggctttagacatagacaacaatcctagaagtaaaagataaatgcagcaatgatctcaaaattttaaaggaaagtgatttctaatcaatacccagcctaagtattaactatgggtgaagacagacaaaaaagactttcagacatacgtggtctccaaatgtgccttccatgttccccttctcaggaaattactggaaaatgtgcttcaccaaaatgagagtgtgcaccaagcaagtgaaagacatgagatacagtaaatgggggaccccctagaggggacagcgaagacactctccatgagagaagaacattatgcagggaaggaaaggtgtactctgtggctcaccataccatcaaactgaaaactaattagccaaaaccaccagacaactatattaggaggacagagggatgggagggtgcgtacatttgatgagggtgggtgccagagttgacttctaacctcccatagagagaagtcaatagatgatacctaaagttgaaacgtagagaaggagcaacgaaaacttaccatttagagaaatggcagtaacaacaaaaataacccactaagacagatggaagcagttgtctcagagaaggggaagaggagggggagcacagatgctgctgtttttgcaatcctatgcatctgtaactttgataaataaaacaatatgagggaaaaaccctgcacacaggaagtgtctcagaaaattcagaagggcagtaaagcttccaacagcactgccaatggtctgacattgttcgaccaccaggttctgctgctgttatgcctgtttgtaccttactgcaatatcccagtttatggccatcaaagctcagcatttcacaagcacctaaaagatacaaagctttacactgtaaccaagagtgtggaagccactcagtcagcaggtatgttacacacggatttccaaagctcttaccagcagtaaaaatgcctttcgtgctctgtcttatactagacggtctcacgattgctgaaagccctgcgagaaaaaaaccaaaaaggagaccaaaaaaacccaaaacagatgttagtcatcttaacagttttaaaacttgaaactaaatattctttctagtcagccaatcaaaccaccaaatctatctctgtcctgctgtcacagtgacaatgaaaagggcagtgggattgagggccaggagaccagagcagccagccgtggcgccacccggctgtgtgagtccaagccgatgaccgaacagctctgtgcctcttccccttaaaacaaggggatgggttagctgaccctcaaagggcattttatgacttaaatctgcttgagatttctggttctcaattccataacatgaaaagataaaaaccaaatgattacatctacgagaaaaactttcattctgaaaacacacatacggattccacagtgaggaacaagtttcactcacctcaaagagacggcccagatcacactgttgccaggatcatgttcaaacaaacaacagtgtgcctcgtacagagctatcttcaggatggggagctggtgacctaaacacacactctgcaaacctagtgcaggcccaggaggagagtgggcgtggagcgcctgctgcagctcatccactgcagtgcgatggtctttgcaaagcattactggaaattctatctggcacgcggaggagctcagtaaatatttactgaatgaaaacaggagaatgcactcaattgacagagggactcattctcaatttcataaatatttcttgattgactgatctcataaattacctttagcaccttaaagggaagttagtctctgaagataaggttcaggctcttttttttgtttgttttttaagagatacgggctgctctatcaccaagcctggagtgtagtggtgcgatcctagctcattgcagcctccaactgctcaagcgatcctcccacctcagactcccaagttagctgagattataggcatgtgccaccatgcccagctacttttgtaatttttgcagagacagggtcttgctctgttgcccaagctggtctcaaactcctggcctcaagtgattctccctcctggacttcctaaagtgttgggagtacaggcgtgagccactgcacctggcctgggttcagagttttggataaacatcagggcagtgctggggaaaatgctgtggaacgtgggccatgtctgagggaatgtactcaacaatgtatgagacacatcaaatggagttgattgaggaaagctgtgttctcgatgttataaaagcacaaaaaaatgccaccaatctcttttctcagaccaccacaaaacacagacacatcttttaaataaattctagaagttgtgctctaggaaccaaaagaaacattgtttctccctttgacagtgatttaggatccaggaatttaaaaacagaagtattttcaccatcttacttcaaacaaataaaaatgcagatttagaaaaccctcaaatttttagtgctttcttcttctgagaggcaatctctctatctcgctaaacaaaaaggaagaaataatacattccaatcacaaacaaagtctgcttttccccatggctggcatttcctcaacatcaaattcataaacgtacctagtcgcaccacatctccacagtcgggatcatgagccacttggaataaagtttcttccacatctctgttttttccaggagggtccataatatgatttatctgttgctgtaaggttttgggcaatgtcatcagctgagtgaactgtccttctgggcttttatctatctgaagggaggaaaaaaaagacgacgtctatggaagtgctttaaatcctacaaatactccaaaactcagggcttctctttaaaaatcacacaaacatatatgcacccacacccctggcgaggcagcaagctaaggaaactctctttttctgaaactgaatgggtaagtgttcaggagtctaagtcccttcaaaaaggacaattcttgtcctataatattccatttctacctgagaaaagaatagaagccactctcaaggatcaatttctgacttttggttttaaaatttatatttgtcttaaatccagcagtcaaaggaagtggtgctgcagttgacactcgtggaggccgcgtcaaatccaggcactgagatgacccctcccatttcaaacacagggagactggcgtgccctgatcacatcaccaatgagagtaagtgggatctgaattgtgtctcctgcctgtagggccttttagtatgctgtatttcacaaactgtaggaatacactgatgacagaaactaatcttacttacttttaatccccagcacacagtaggtactcaaaaaacaataaggaaatgagtaactgaatcaatacaacttagttgtcctaaagctactatgccagcggcttcggttcccaaagtattctaaaacatactaaggtgctgaagataaatatataaataaaacatgtaaaactatgtgtcagactttactcagaaacccttgaatcaaaagttagccacagagctgaggccagacctagctttcctaactccaagtttcatacactgtgcctcgtggaatgaatttttaaaaatcttgtaaacattgatttcctgccaagtgcagaaccagtaacactgccctcaacagcccatcacattatttcccaaggaagaatctgtcttgtatccttttaacaaatatttaggttttaacttcaactaagagaagagtaagaaaaaatcagatcaatgtattacattttaggcttagagtttacagataggacgaactttcttaataattagaatccactcattctaccattttttaaattgaataaatatttattaagtacataccaaatgggccaggagcacaggttcacacctgtaatcccaacagtttgggaggctgaggcaggagaattgcttgagcacaaaaattcaacatcagccctagcaaaagagtgagatatccggctctacgaaaaaaaaaaagaaaacaaaaaaaagccagacatggtggtgcaagcctacagttctgtctacttgggaggctgaggtgggaggatcacttgagcctgggaagttgaggctacgatgagtggtgattgtgccactgcactacagcctgggtgacaagaccaagatggtatcaaaaaaaacaaaaaagtatataccaaatacctgaattttctagttttgtctataaactctatgaagagaaggagaaaaatgttattatttaatggctccataaagctagaggggtaaatatttaggtttttatctaaatatttgatatttatcactaggatggttctaaattcacaggccccatcctctacttagctttggctacaaaaatgacaacaaatttgagtatttatgtaaaataatcttagaaatgacatttatggacttatgttttgaggccacatattgggattagttagaataaacttatatttaagttatgctttacctatgaagcttccaacggcttgagtgacatataaaaaaattagaaagtacttatctgccactgctttctcttgaggaaaataatgcactggaattttcacttgaaagcatgagtgtaaagataaaataccaggtgacatgatttaaaaatttggtaaattctcattttccttacactaactctcattaaaataacgaaagtgaaagcattcagctaaactgtgaaagtcaaattgcattttaaaagcggacatggatacaattattatatgtcaacttaagaaaaaagcagatatggaaaaaactttatatgattccatgcatatgaactgtccagaacagaaaaattacagagacagaagtggattagtggttgcctgggtgaggggagagctggggacggctaaagggtatggagtgacagaaatattctaaaattacattgtggtgatggctgtgcagctctgtgactatactataaacactagcttttatggtgtatgaggtattcatcaataaagctaatattttgttattattatttttgagacagagtctcgctctgttgcccaggctggagtgcagtggcgcgatctcagctcgctgcaacctccatctcctaggctcaagtgattctcatgcctcagcctcccgagtagctgggattacaggcgcacaccaccatgcctggctaatttttgtatttttagtagagatggggtttcaccatgttggccaggctagttttgaactcctggcctcaactgatccacccacctcagcctcccaaagtgctgggattaaaggcatgaagctgccattctctccccctggccaaaagagtaaagaaaaaataaaaccatatcccaggacgaatggcagagatgagcaccacctgtagacctaaaagatgcaagggtaaggcagataattttatgtgtcaactcagagcagtggcacagcctgaagacactgtcctgcgaggatgagttgtgctacacatcctgaatcaatcaccattacgctgtactatattcccaactggcagaagacatgggcctggggaccaagggtagaaagagaagtgaccttgcttatcgtcattcccagggacccacttgggaacactttgcttcctatcactacagctctagatctgtgggtctagaggtcccagttcccagagaagggatgcttctaccagaggacatagtaagcatcccattaactttaagttacgactgccacccaattaatttagaatcccatgccgtaagtccagcagacaaggcaatgagtcactacactggcagaagcaatcggccctggtcatcaggagctggggtgctgatacacgtctcttagagtaccccttgcccaattttgatggttagtggacaagtgcggtagccagggtcctccagactcctccgagatgagggtctgggccaccctgtctagataagcagaagtgatagatgagggtgaagggaatctggaggagtagcagagatgggagaagatgagtctcagttgcagcctcaaggccagatacagcactgggagctgtagctcagtcccccagtcttattcttgtaagtttcctgggaaaagaaactgatgcgaaactagatcatgcaggcttttataggccatagggaggattctggatacctttatttttatagttagagaaaattcctagcccttttcccttgttcagtttctagaaagttggtagacagacacattatacttccctgtcctctagccagagaatagaagatctctggagaaattctacagacactgatatttgagatcctccaataaaacagctaggtccttggccaggtgcagtggctcacaccagtaatcccagcactttgggaggctgaagcgggcagattacttgaggtcaggagttcaagactagcttggccaatatggtgaaacctcatctctactaaaaatacaaaaattagctgggtgtgatggtgcatgcctgtagttccagctatttgggaggctgaggcacaagaatcgcttgaacttgggaggcggaggttgcagtgagccgagattgcgccactgcactccagcctgggcaacaaagaaagactccatctcaaaaaaacaaaacaaaacaaaatagctaggtctttgcctcataatcctatagtcaagcccaccagttgacaagcctgatatatcacaaagaacttccagcctgtattttagtgcctcattctttaaaaacaggccagagccaggaacggtggctcttgcctgtaatcccagtactttgggaggccaaggcaggaggatcgcttgagcccaggagttcgagaccagccagggccaacaaagtgggaccctgtctctacaaaaaaaaatttaatgtctcagatcatatgggtacaaatatatgtgtgtgtgtgtgtgtgtgtgtgtgtgtatgtatgtatatatatgtatatatgtatatatgtgtatatatgtatatatgtgtgtatatatgtatatatgtgtgtatatatgtgtatatatatgtatatatacatatacacacatacacacacacctgtgtatacacacacacacacacacacacacacacataaaaaaatcagctgggcatagtggcatgggcctgtagtcgcagctcctcaagaggctgaggtgagaggatcacttgagtgcaagagttcaaggctgcagtgagctatgatcatgccactatactgtagcctaggtgacagagtgaaatcccctctcaaattgattaattcattaattaatttaaaaaatcaggccaggaaggaaactcagacatttgaaaaaagcttctaacataacagactagagtaaaaacagacaagaggaactaagagaaagaaaacagtgtgagagaacaagacaaaatcttcaaaagttataataaagatcattaaagagattaggagaaaataatgcatccataatacaagaataggaagctataagaaagaacattttgggaaaattaaaaatttagtagaagtgttagaaaaccaatcagaaatattctcccataaagctaaatttaataaacgaagagacgagagagagagagagagagaaaggaaaaaaggttaaaccaggaggtctagcaaccacctaacaggaatcccaggaagaacaaactaagaaaatgggtatgaagaaataattacagaaataataaaaaaaattccttagaattgaagcttataaaattccagatagaaaaggcccactgaggctgggcgctgtggctcacaccagttaacccaatactttggaagaccaaggtgggaggatggcttgagcccaggagtttgagaccagcctgggcaatatggtgaaactgtttctactaaaaacacaaaaaccagccaggcgtggtggcgcgtgcctgtagtcccagtagttactcaggaggttgaggtgggagagtcacttgagcttgggagtttgaggtcgcagtgagctgggattacgcctctgcactctagccagggcaactgagcaaggccctgtcaaaaaagagaaagaaagaaaagaaagaaagaaagagcccaccaagtgactgaataatgaatggaaaacagacataaataaagaaggaaaattatctccaccctagaatttgatatctagccaatactatctatcaaagggagggtagaattttcagaggtatatagtctcaaaaacttgcctccctcacaccctttaagaaggtaataaaagacaaacttcactaatatcagagtataaaccgtggaagaggaaaatgcaagacccacaaaaccaaaaactagcacgggggaggcaaagggaattctcagggtgataatgaagggaaggtggaggagtgcggctgtgcagtgagctagaaaacaaccagttgagaaaggaacagggcagggggctccaggaaaaacattcctgtgagaaacaagaaacagaaaatacccaataaatctgtctataatgggaagagttttacggatctgtcaagagtttgaggatgactgacctaagcaactgaaaaaataagacaactattaactccaggagaaacaaagttgtacaggaaaaggaacttcataatgccacagctcatcaataaagaaaaggctgtcacaataaaataaacattgaatattaagctaacaaaaaatatgaagtaactttatgtgaagcatgagggcgtgaggtagaaggggaagagaatgtgtgtgctaagtgcatgtgtgtgagtgtgtaattggtataagaattgatggggtagtgtaagacggtaaaaaaaatccccttcttccaggatggcaaaaataaagtgtaagattgaaaaaaaatcaagaaataatagtcgaagcatattatttagaacatggaggtgaatatcagaagaatcagctatagagacgaaagcagctgcctctggtaagcagggctgagaatgtgggaacgtatgcagcacggaactgctctttttgttataaacttgaggtatcatttggcttttaaatcatgtacatgcataaaacaaaaaacctcaacctgaaccaaatgtggcaaaatctgttaaactgagtggtgggtattctcgcatttcatatgtcactctctattcttttcttgttttaaaataattcctatttttttaaattccctttttagctctagaaattccattaatctattactcattacaatgttagttgcccctactatgtggatggagaagagcataaatgaagaaaaatacagtgttctttacattaaaggaaaaaaaaaaaaacctttggcccggcctggtttttattttcaaacaaacacttaatattaattgaaacaataccttgataagaaagttttatttgatatatcaaaaagaaaaattcccagacataataaacaaaacaagtggggaaagaagagaattttgaatatgtatgagcccattaatgtataacaaaaccaaacctcttcctatatgcatacaaacatatacaaaagtacacgtgaaaagatctggaagaacagacagcaggctgggtgcagtggctcatccctataatcccagtacttttggacgctggggcgggcagactgcttgagctcaagagtttgagaccagcctgtgcaacatggcaaaaccctgtctctacaaaaaaaatacaaaaattggccaggtgtggtggcatgcacctgtagtcccagctactcaggaggctgaggtgggaggatggcttgatcccaggctggggggtgttgaggctgcagtaagccgagatcgtgccactgcactctagcctgggaacagagtcagaccctgtccccccaaaaaaagaaaaaaaaacaacaacaaccagacaccaaactgtcagtacagttacctctggggagctaaatgggtctggggatggaatgagagtgatctaaaagtttattttcacttgttttgattggtaattgatagacatggtaataatttccaatggcaaaaaagatatacatggtcaaaacaagtccctctcccacttctgcccctagttcccttctccaaaggcagcctcttattactagtctgttaccttttagcattattccagatacacagaagcctatgtttacatacagtacttactttttaaactataaatgttctcacaccagtcatgctgttctacccctgactttcttcctgcaaatagcctttgtcttagaaacaatacaagctattttccacatacagttacctccagccagccttgctggcttttatacaccacttgaggattttcctgtagtatgctgccatagagctctcgaaagtgggctatattgggcttcacaatattcaacacttttgttttatcttctccaaccaccatccgaaagtcacctagttaaaacaaagagataaacacatcttccattaagaatccacactctcgacctatgaacgacgctccccacactgataccgcacgggttcactctggcaggatccctcatcagaacacttgcttttcctcctcaaaacctggacactttaccccaagaaatgtgagcacttgtttggaggaaaagagggtctctcaaatcacaaagccctttatgccagttaaattatagttacctagttacacaaggtaatcacaagcgagtagctaacttgttttagcttttccaatgcagaagcttctgtacctacaaagtcttgtcttatgggccaaattctgcctgtggccaatgaaggagataggagctgtgcaccatcactgtagacttgtccttgccattgcttcctcatcgttgacctgtctgtttatgagggcttttgaggcacttgatgaatataatcttatcatattttacaaaggcaaaataaggcttaaaagttctgtaagaggaggtttgcatttaagatgaaattgaaaacagatataactttttaaattgcaagtgatgagaaatgaggaatgttacatttgcctatgggatgaattgagctgaaaaacacctaattctgaaagacaaaagcatttctgaatcaaatgaaaagtgccctgccaatgccactgacaaccatcggcaagatggaggagaaaggaatgggaaagtggacacacttaagtgcatgcctactgggctaatgtgaaatcacaagaggctggacacacgcagaaccttctgagtcaagcgtggtgaaagcaatgtggctgaatcctttgttggagagggagcaaattgtcagggggagtagagaggtggcaagtgtaggcagataacccagctgctgaggaatcccctggggctaggatgacaatataatttatcatccaaactaggtcacttctgagggtgaagggatcgctataaataatcacactacgacaagtataaactgagcaaaccaggacatatggttaccctcgccaatttcttttttctggagaggggaagggatcatagaggtcattatttgccacaatggattttcctagtgcaaactgttggcttgttttagaaaaagtaaaaatacaaggaagaccaacaatatgtacttcattgagtaaggaataaaatatgctaggttttaagcttcaaaggaccaacttacactacaatttggtggaatgcaactggggactgcaagcttagaaaaacagacttccaggctgggcgcggtggctcacacctgtaatcccagcactttgggaagccgaggcaggcggatcacgaggtcaggagatccagaccatcctggctaacacagtgaaatcccgtctctactaaaaaatacaaaaaaattagccagacgtggtggcaggcgcctgtagtcccagctacttgggggggggccgcaggagaatggcgtgaacccaggaggcagagcttgcagtgagccgagatcgcgccactgcactccagcctgggtgatgaagcaagactccatctcaaaaaaaaaaaaaaaagacttctaaagagcctctggaacccgatcttggtgtacagggggtctgactgttcaggtgagtgagcagaagcgagtcccagtcctaaaaatctgctcaaatatggatgaacttgtttttgtcactattattttgaagggaaagagagttagatagttaaaacctgggatcactgctaatgaggaggttgagaaatcagtcctttcacatattgctgttgactgcataaactgctaaaattcttctggaaagcactgaagcaagaaaccccatctctggagcaagcttaaagaaataagccagaaacacagagtaagacagaaacacacaggtaacgtttaccgagcatctggtaaataccagccactgtgccaagtgtgttgtggtattgcttcatttaatacacacagctctcctctcaggtagataggattctatccccattcatacacaagggaacaaagacagtgattaagaaacttgcgtaaggtttccaggaagtaaaaatatactacatatataaaattgctcactgaagcactacttataatactgaaagcatcccaaatgtccaacaacaggggaaagaatgcactatgatggcatatggttactatcacagacagtaatcacacacaacaagatggaaagtgatcatttaatatgcagtaagaaacaaagagatacaaaagtataacaggctgggcatggtggctcacatctatagtcctagcactttgtgaggccaaggccgggggaatgtttgagctcaggagttcgagaccagcctgggcaacatagcgagactctgtctctatgtaattttttttttaagcataccaaaacaaaaaaaacttcataaaaaatgagaaaaacaagacaaagagactatataaaaatgcttatttttgctctaataaaatacatttattgtgggtttttgcatgtgtgctttaatttgctatctcatttggtcatggcaaagctccataaaataagtactattattcttaattttacagatgaggagatggacgtgcaaagacaacatgccccaggtccaactgcctctcggtattagggtagtgaaattttaggtgatgattttactctataatttccccccatttccctcacttctataatgctggcatattactttctagcattttaaaacacatttatgggatacacagatgatgacgtgacaaatgtgaatggagtggtggctgagttaacttccaactgtgtaaatccttacacgtataaaaatggattccattaatctttgaagagatgaaatgtcatcaaattctgactctaacaaggctggccctgaagtgaaagatcagtttctaaaactgttgaattctaaatatttgtgtcattccttctttctgtacattccacaaacaaaaagttcctcaattttagacagtcactttctgagagaaggatttaccattttaaaatatcaaggattatgttttacaatccaaatcttccccctaaaagaacaattgcatgccatgattaaaggacctagaaaacactccaggctctcggagaacaaggaccggggcttatttatgtctgcatccttagctccttgtgcactgcctggcacagggaacacatacatcaataaatgtgtgcagaactgaatttctctcactggtgtgcagctgaactagctcaaccgcaggggataggaagcaaatgggcttatgactcatttcttcagaacaaaatgaataacatcatgggcacagcacgaaccagcatctgatcataacaatcaatttttcttaccttgggagatttgttttcaacaaaactacagcaatggattaaaactgactgctgactttattttatgcctctagaactgccagtacaataggcatccaaaaggatttctccttgaccttgaaatgatacaaactccaaggcctgcaagccacctgtaggtggccttccctgtgattcaggcatgcagccagcagtcagggacctcattacaagtatgcagatgtgaagggctgcacagtacagcggcaaggccctggctttcaagtctggcaatgtcccagggtgactgaggtcaagttacttaaaccttctgagtccttcactgtaaaatggcttaatcacactaaccttacaaagttgctttcagatttaaggagttagggcagcagtccccaaactttctggcaccaggaagaggttttgtggaagacaatttttccatggatgtgggtccaggggacagtggtttcaggatgattcaagcacattacatttattgtgcacttcatttgttattattacattgtaatatataatgaaagaattatacaactcaccataatgtagaatcagtgggagtcctgagattattttcctgcaactagacagtccctctgggggtgatgggagacagtgacagatcaggcatttgattctcataaaaagcctgcaacctagattcctcatatatgcagttcaaataggtattgcgctcctataagaatccaacgcagctgctgatctgacaggaggcggagctcaggcagtaatgcaagtgatggagattggctgtcaatacaaatgaagctcgcccaccactcacctcccgctgtgcgtcctggttcctaacagggttcccaagggttggggaacccagagttaaggtattagagaatgctttgtaagtagtaaagcagatactacttatgatatgtatatagcatagtcgaaggatggagggtagaggaagcgctgggtcttggagataataattaccggctaacttttctccctttaaacgaattgcaagactgctgtcatttcagttcagtgaatatctgagtggctacaaagtaccaggagctgtgctaggcaatggagatccaggttgggcaaccctaatctgaacaccgaaaatgcaaaatacccccaaacctggaaaccttttgagcactggcaggacaccacaagtggaaaattccacacctgacctcatgcagtgagtcgcacatattattaaaaatatcatataaaatcactttcaggcgatgtgtatgaggtgtatatgaaacataaatgaacttcgtgtttagacctgggccgtccccaggatatctcattatatatgtgcaaacataccaaaatctgaaaaattccaaaatctaaaatacttctggccccaagtatttcagataagggatactcagcctgtccagatataggctctacctcaggcagcaaacagtatgaaaaaaagatcatttcagtgcagttttttatgtggtagtgtttaaggactgcagcccaaactggatattgatatggcaaaataatattcattttcatgactgtttttcagatataattcacataccatgtaattcatccatttaaagtaaataattcagtatttttaattctgtttacagagttgtacaatcatctctccaatctaatactagaatattccagcctccctacaagaaaccccatactcctaagtgatcactccccaactcccttcattccccatccccagcctgaatttaaacattgctgtcattttggttcagtgaatatttggctggctacaaagtaccaggagctgtgctagacaatggagatccaggttggatctaatctactttcttgccacagatttgcctattctggacattttatacacattgaattatacactatctggagttatttttacgaccttagcaaaatgttttcaagggtcatcacactgtagcatttatcagtacttcactcctgcttatggttaaataatagtccatcgtacagatgcaccaattttatttatccatttctcagttgatgaacatttgtgctgtttccacttttgggcgattcattatgaataatgctgctacgtacaagtttttgtgtggacatatgtttcatttctcataggtagatatataggagtagaactgctgggtcatatggtagctatgtttaacatttggaggaactgccaggcttttttccaaagcagctgtaccactttacaatctaatcagcaatgtatgagggtcccaatttctccacattctcaacacttgttcttgcctttcttttttatcacagccattgtagcaggtatagaatggcgtctctgtgatttgtattgatgtttccatttccctaatacctatgatgtttaacaacttttcatgtgcttactggccatttgaataccttttctgaagaaatggctattcaaatccttctcttgtttttaaactggattgtcttttcattgttttgttgttgttgttgtttttttttttttttttttgagacagagtcctgctctgttgcccaggctggagtgcagtggcatgatcttggctcactgcaacctccgcctcctggggtcaagctattctcctgcctcagcttcccaagtaactgggattacaggtgcacaccaccacgtccaactaattttttgtattttcagtagagacagggtttcaccatgttggccagactggtcttgaacccctgacctcaagtgatccaccagccttggcctcccaaagtgttgggattacaggcgtgagccactgcgcccggcctttccattgtgttttaaaaattctttatatattctggatactagtcccttatcagatgcatgatttgtaaacattttcttccattttgttagctgcctttttactttttttttttttttttttagacagagtctcactctgtcacccaggctagagtgcagtggcatgatctcagctcactgcaacctctgcttcctgggttcaagctgttctcctgcctcagcctccctagtagctgggactacaggtcaggtgtgtaccaccatgcccggctttttttttttttttgagacagagtcttactcggtcgccaggctggagtgcagtggcatgatctcggctcactgcaacctccgaatcctggggtcaagctagtctcctgcctcagcttcccaagtaactgggattacaggtgcacaccaccacatccaactaattttttgtattttcaatagagacagggtttcaccatgttggccagactggtctggaacccctgacctcaagtgatctaccagccttggcctcccaaagtgttgggattacaggcgtgagccactgcgcccggcctatccattgtattttaaaaattctttatatattctggatactagtcccttatcagatgcatgatttgtaaatattttttttttagacagagtctcactctgtcacccaggctagagtgcagtggcatgatctcagctcactgcaacctctgcttcctgggttcaagctattctcctgcctcagcctccctagtagctgggactacaggtgtgtgccaccatgcctggctaattttttttttttttttttttttgtgacaaagtctcgctctgttgtcaggctggagtgcagtggcaccatctcagctcactgcaaccttcgcccgcccggctaatttctgtatttttagtagagatggggtttcatcatgttggccaggttggtctcgaactcctgaccttgagtgatccatccgcctccacctcccaaagtgctgggattacaggcgtaagccaccatgcctggccttccttttgtatacattagaaaatacaaaagtaggaagtaatagggaggactcaggttcactatattggttcaggaaggaagcagtataatccactcatcaaatatttactgagcacctagtacatgtcacatactattggaagcatccaaacagaaggagcaaaacaagacaacaattccttccctccacatcctcagtggtggaacaaagaccaaagatcagccagccaaccaacaataagatacagtgtagccgactgtggaaagtgctatggggaaaacacaaacagggaaagacatagggagtggtggagttgcagtagcagtcagggaaggcctccatgataagccagaactgaggcccactggggtgggtgtggggaggggaggtgtgacccagtgggtcctggggaaggagtgacctaagtgtgaaccaggagtgacgcccaccaccaaagacctttcatagaacagtgaagtgttaagagcaagcattccaggaagaagactgcctgggttcaaatgctagctcggcatttacaagctatgtgacccagggcaagccacttaacttatctgggcatcagtatcctcaaatgaaaaaggggagcaataactagtttgtacatttcagggactgaatgaatgttacaatacctgacacacagtactagtctaaaaagtttgggtattgttcatgctttctatcccttcaggagtgctgcgttctcagaaattagcaaatgactactgagtaacctgagttccggctgaggcacagagaagcaggcttccaaagtcctgaggcagtcagctcccatatgctgatacaaccacactgcttgtaaggtttcagatggcttcatcaccacagaataaatcttactagcttccactccagagaaaacgtttctttactggcttctaccagaatccagaatccacactttagagagctggcactgaatgctaatttttttccccaagaatcactcaactggcaacttcctcactgcttcgtcttattcctagaagtagctgaggctgtgttcagacaatctggcaattaaagaaacccattctctctctcataggagagtgcccgaaagtgtttttcattccatgaggaccttaaccggccagatgaaatggggctgtcatgtttcaatccatctgatctaagtactcagctaattttttttttttttaatttaagaaacagggtctggctctgttgcccaggctggagtgcagtggtgtgatcatagttcactgcagcctggaagttgggattacaggtgtgagccacagcaccctgcaaattttgacaggcattgtttgtcaatatgtaacaagttttataatttttatagctgacaacataattccactttggagaacacatccaaggaagtcagtgcctcctttgcccctttcccaacgaaagtaatctgtacaaagtgattcacagcagtgttgctaataaaacagtgagaaatggagctaatataagtgtccatcaatcactggatgattgagcaaataacagtttctcaacctgaggaaaacccatctgaccaacaataatacataaaaataataataacagcaatcattttctgaacactgactattaatgagataagatgctggaggcagccaggcgcagtggcccacacctataatcccagcactcggggaggccgaggcgggaggatcgtttgagctcaggaattcgagaccagcagaagcacacagcgagcccctgtcgctacacaaacgaaattagccagccgtggtggcgtgtgcctgtggtcccagctacttgggagtctgaggtgggagggttgcttgggcccgggaggtcgaggctgcagtgagctatgatctcaccactgcactctagcttgggcgacagagtgagaccttgtctctcaaaaaaaaaaaaaaaaaaaaaaagatgttggaagctattatacgtattatctcattgataatttctttgtgagatagttatttgttttacaaataagaaaactgggggctcagaaaggttcaagcttgtgtttcaggaaataaaataatgaaaaacaaataaaacaaaaaagaaaggttcaagatacctttagaaagctggtattcaaactagtccaccatgtaccagatgagtgaccttagacagggaaccattctgggcctcagttttctcatctgtaaaatggggcaatgatacagcacccaaatcaaaaggttaatgtgaggattaaactagttaccaaatttaaagtattgagagtagtccttggcacccaataataaaggctattttccctgccattaagccacagacttcagtcacatcagtctactgctttcctcctaaacacatcatgttctttcacatccttcttgcctttttcacacgtgttgtttttcaagtctaccactgactcactgtgactgcatgttattaatgtgaagctccttagagcagaaattccatctgcagttcttcagggtatggaatgctaatttgcttgataaatattaaaccaaggaccattgcctaaaattagtcattttaatagttgtactgacataacaaagttcaaggtgactctttaaaatgcatttggtgctcctttcctgttcatttaaatgctgacttctaagaaaaactagagttagaaagctttctttctttcttttcttttctttttttttttttgagacacaagacagtctcactgtgtcatccaggctggagtgcactggcatgatcttggctcactgcaacctccacctcgccggttcaagtgattctcctgcctcaacctcgcaagtagctgggattacaggcatgcaccaccacgcctgactaatttttgtattttagtagagatggagttttgccatgttggccaggctggtcttgaactcctgacctcaagtgatctgcctgccttggcctctcaaattgctgggattacagggccaccacagctggctgggttagaaagctgtcttaaaacagaaaagaggaaaaaaaaaaaaaaaaaaaggaggggggtggaggaaaaataataaaaataaaaaataaaaaaagataaagctttctccttcccagtttgcagcctctcatcctccacctactctcttctcacccataatttataataatactgacctcagggcagtcaaagtaatcctaaaatactatataaaatgtaaaggattgttattgctacaaataataccaatctcgcctctgcctaagtaattactggcaggaacttgtccaacaacatggacagacatggtttttctgttccttctcctgcccactcccaggaaaaatactgaacttcacagattagggaccatatataatctcacaactggaaaaagatggacaatgcaaagttataaataaaaatgagattagtagacaatatgaattttggcatattctcagggcttcggagatttgggtggtttgccaagggatagaaaccaatcaattctacaacactgggttctcagaagcctacaaaagtcaggaggaaaatgtgcctttcaacactttgcctggggtaggtctcatacctatgaaagagatctacctacagagcctatgtcattttctaccttcattactctcttcttgttccagcaaaaatcagctaaacttggtagcagcttgaaggctaaattaaaagtcttcaaagaggtgaaagcagctatgtcatttggtaaatttccttagtaatattcagaatttagaaggaactcccagaatccatccaatgctacgaagatgttgactagaagggaagaaatggaggactggtagtggtaggggcagagtagagatcagtcctgcatcttctcccaccaagtcagctttcataaaaggcttccgttccatcatttttcacaggggagtatggaaaggtaatcactctaataaagtgacttcctttgctcacacagtgtgcatgtgacctgctcattccagcacagggccacgccactctttgcccctatgtcttttgttggaaggcagggaggctgccaggtgaagctggaagcacccagagaccaaggttgcttcaacgcctttctctacagtgttgcaaatacagccgtagtcatggtagatgaattttgggaagatggaagaacaaaacctctaaggtctcttacagcattaaatttccatgaaatcttacctgtctgtactgggatttggaggctaagtaaactgcttttccaatgttctgagcataaagttctttgactcatactcaaaaatcgggaaagatgattttttttaagatggtggttttcaaactttttaaaaagcggcagagcacttgttttgtaaatgaaatcttaaacggaaccttactatagtaaaaagatagatgggggctcctctggttgcagcgagggtgagtggccaggggctctaccctctcagttgtctcagtttgggacataatatgtgtgacctaccctcaaacagtttagaaaataaatatatatatagtatgtttacacatacagagaaaacagtggttctcaaagtgggatccctggaggggcatcagcatcacttgggaacttgtttctaaaaataaaaattattgggccctacctcaaacctattaaatcaactgtctggggtagggcccacgagtctgtgttttaacctgagacttcctagttgttcagacacaggctaaagtttgaaaaccactgatacagaaacaatgagaaaacaaatatggtgcaatgttaaaattggcgaatctgggaaaagggcatagggagttttctgtattattcttgaaacttttctgtaagtttgaaattacttcaaaataaaaattaacaaaaacaacaaaattaccctgggacaataagcatggagatgtggagaggggacccaggaggtagggaggcaaatcacgaggttagtgcaggaaccactcaagagtgacgtgatttacaactaagactgtagcagctccagggccgagtgagaacaggatatccgcagtcttcaaatataaatctctcccttgtagaacatctgggcagcaaccatactaacctgaataggagagaccggcaatctctatgaagaggtcttcttcagaaaagctttcggggagcatgaggaaagcagcggtcacagcactcttcagatttctatcgagggctgatctaagagtgacatcctcgttcactgagataattttcacctgaaagaagcagaacattgggaagaaaaattccagaagtggagtattgctcaagcatgggttacaaatgcactggaactatctcaaactctcttcccactgaagatcttggaatactggttcaggtgacacaaaattgttcctctaataagtaatcccagaatctccttgttttatgccaaggtcaaagaaatcatgacacaggaaaggatcaaaatgccaaagaaaacaaatattcttcttaaatgaggaaatgcagcataggtttagaaaaagagcaaaagtcctttggaaactttaatatttttaaattttataatctcactgtcgtcacttaattttttagtcgacagaggcattttacctctttatttagacctcatctgtaatcttggaccatatctaacataggaagttcatgctctatttcgcactttctagatacatcgattttgaacttgactaaggaaaaatgaaagaaaactagctacagtagaaaaagaacgggttttagagataggtatgggctcaagtccaggtacttactagctatgtgagtttgggcaaatgatttgcatcaaagaatcgtcacaaagattgactataataataaatgtaaagtgcctagaatactagcaactgcttcgctcagaaagaatttttctcctcaatacagagtagaagcttccatctgagactttctgcaaatccattaaaatacaaagagtgactgggtgtggtggctcacatctgtaatctcagcactttgggaggccaaagcagggggatcatgagaccagcctgggcaacatagtgagaccccatctctataaaacaaaaacaaaaaaaacaaacacctagccaggcacagtgatgcacatgtgtggtcccagatactcaggaggttgaggtaggaagacagcttcagtccaggtggttgaggctgcagtgggttgcagtgagccatgatcatgacactacactccagcctgaaagacacagttgagaccctgtctcaaaaaaaaaaaaaaatactaagagcttcagtctgttctgagattcttacttttaaagattgcactgcagttaagagatgtgttcaaatgccaactccatctcttactagctctgtgactatgggcataattccttatcagtaaaatggagtaaataacagaatcaagctcataaggctgctagaaagatcaagtgagttactgcacacaaacccttcagtgaaatgagcttccttgtgtgtgcttctcagtgcacaaggcaagagcttctctgggccagcggttctcatctttagctagcattagcttcacctggagaactcgttaaaatgtgtattatcggatgcaactcccagagttctgtttcaggaggcctcggtgagggctgaaaaatgtacatttctaacaagttcttaagcaatgcccagggaccacattttgagaattactgctctaaggtgcatacttagcactgtcaaattgctcttcagagtggttatgccaatttacactcgtaccatgatcttttaaaaacatcatactgtttctgattgactttctatacaaagtaaagggtctagaagtcccttaataaggactctcatatgtctaaaatatatctaccatctctaaatcttttggtactatcgacacattttctacctattctagaaaacagggcataagttgccttttatttgtcaaatacagataatttctgacaaaattaagatagcacataaaagacacactatgagaaactccaaaataaatattagaaagcaaggaaagaggagaatgctgcagtattccaaggcatagcttcttctcttctaattgtaaaaaacagtattataaaacatataactattattttataaatcaggcttcagaatctgaattcttttaccttttttccctacttttttctaagggagtatttgtaacatacaaacatcatatatggtaggtaagccacttgattcaataacaccccctcctcccttacaattctgaggacttaatggaccttaattaagcctttcagcacttaggtgagtttagtattactgcaatcatctgcagagagtaacccatgaccagccaggaacatgacttgcctacagttgcataatgagttgacaacaaaaatcaggatcacattcttttacttggcaaattcagctctaaatattctgaattattctcatgcattcatttagggttatattctggttaacttatcttgaaagatgattaaaacaaattttaaggtcctataaaaacacctatgcttattccttgaataactttcctaaaccttatagagttggctcttcgtatctgtgggttctgcacccatgggattcaaccaatcacagatgggaaacattcagaaaaacaaaaaaaaaaaatccacaaagttccaaaaagcaaatgttgaatttgctgccacatgccaattactacgttgaaggcaggcgaatgatgtgaagtgtaagcacggtattaggtattaacagtcatccagagatgatctaaaatataaaggaggatgtgcataagttatatgctaatactaggccattttatatcagagacgtgaattctgagggtgggtgcaggtcctaaaaccaatccccatggacaccaagggatgacagtattccatactgaatgattaatctaggagggcaactgcttcatcttactgacagaaaacttaggcctggaggggttaaaggggttaaaagatttctccaagagaagtagtggcgaactggaccgggatccagtcccaggattcacccagtgctctttccacaactctgtgatgtctctctacttccacattcccgttcttcatccccattcatcacacatccttctcaataattcttcacctctctgtttttgatggcttttacagaagcccagtgaaattagaagctattttgagatgctaacaattcaaagatgcaaagaaaagactaagtcttgggaaattttcccagttaacaaaataccacttgttctccaaggaagttgttctacataggctgtaagaaagcagtctgtttgctatttaagattaagaggatgaaaataaaagcatccttactcaaaggaaaaatgtcagttcggaagattctgctactgtgctgatctggttcttcaatgaaaggtgaactaggaacttgtctcagcagcactgttatttgttgttcagagtgaaaagccagtgaactcttgggacactgccagagaggcctgggaaaaaaagaaagtgctcagatttgtgaatagctgtttgtatcttactgggaatgccccgacctgaactgcatagataacattagcacgactgccagggaggaaaatctttactgtagagaaaggggcattggcttaaagggactttcaaaggagatatttgtgagtacctttcaagacaggaaaaaagagaaactcacatgtgggctcctctaaaactgtcacaaggagagactacttgaattgcagagtgaaattttaatcacaaagaccacagccctacctactgttcaaatactcaaccgcccaccagaacttttccattccaaacgaccaggaggtttaactcttctaaatagtcactgcttaaggatgaagaagaaacgctgaacattagagctggatgaaaccttactcaatatctacctgctggactctgggctcttcgaggacaagcaacatgatatcatttttaaaaattcctttggcatacacagagaagaaacagttgtcttttgaataaagaaatgaatgactcaatctgtgcatttcaaacgctagcggcccaaacatttgcttatagtagggcagagccaaaactagtaagccaggttttccaactcccagtttagggatcttttatagcactgggggtttttctatccacacaaaaaattaatcaacaaagctgcaatatggtgatagttgaactctgaatatagtaaaaatcattgaattgtactctttaaatggttgagctgtgtggtatgcgaattttatctcaataaagctgttattaaaaaataggccagacaagggggctcatgcctgtaatcctagcactttgagaggttgaggcaggtggatcccttcagcccaggagttcaagaccagtctgggcaacatggcaaaaccccatcttcacaaaaaaatacaaaaattagctgggcatggtggcacgtgcctatagttccggctactcaggaggctgagatgggaggattggttgagcccgggaggtcgagtaaattgtgttcatgccactccacttcagcctgggtgacaaagcaacactctgtctcaaaaataaaattaaaataaaataaagctacattactaaaaggcaaaatatattgcaatgaatacattaaatcaaaatcctcttaacaaggtggcaaaaaaaccactgcatgtcaatataaatgtcttaaaaactcaagcacaattatttatacactaaaaacaatgtaaaatacaaaaatccaaaattatgttaactaaggaaataactattaattattactttagaggtttcttggcttaaaaaaagtttggtcacaatgctatattaaacactttaaattccatgattttttacttgggaaaatattagtaaactcagaaacttaaggttgtactggaaataaaaatagggtattccatcaattatgagataagttaatggtaaagtatgataaaaatttaatttacactcaacttttcccagaaagtccatctttttaagcaagatactcaaatatatatatttggagacatggtcttgctctgtcatccagcttggagtgcagtggcatgatcttgactcactgcaacctccacctcctgggttcaagtgattctcctgcctcagcctccctagtagctgggattacaggtgcgcaccacctcgcctggctaatttttgcattttttagtagagacggggtttcaccatgttggccaggctggtctcgaactcctgacctcaggtgatccccctacctcagcctcccaaagtgctaggattataggcatgagccaccgcactcggcctatatcccttttaaagacttgaattactagtgattgaggaattctatttcaatttgcaagatgcaagacaattctggggctttagacaatgtaatttaatgtgattccttttaaaacacaaagataaagaattcatactcatattctcataattctttcttaagatatttacccaactttcttgtccaagatactaccaccctcttttcattagatttgttcaagtctgattaatatttgctgccacctagaggcacagatagtttgtttaaaaatcatcattctggttaacagtgatttccacatgttgaaaattgggagcaaggtagaagagagagttaatttgcccatttatcattctcaattaaaaaaaaaatatgttcatcactttcaaatgactttatgataccctaattttcttgtgctagaagcattaaaagccttagaaaataatcattgctatcagtaacattttcttctccaagtcagctgagaaatgcagagttttgcatgaaatgagcatgggtgctactacttgtcttgaattgctgtttttgttttataaggatataacagttagataaaacctgagctcatttccagtgcttacattctgagatttcatggcatttcagctttctaaagccttttttaaaattttgaaacattctaagcataaagtataatacaaagaacaatacaacattttaacattcaatttcatttctatctcaaaataactgagataagcaaaggcacagagagaaggcaaagaccattttctgagtgtctactaagtaccaggcatttcagaaccctctgaggtcagcgccatcagactcatctacagatgaaaacaccccgaggcttagggagactgtcagtggtgcagggtcacaacattaggaagcatcagagctgggattctaaccctacatctgttagattctgaaacactgagttcttcccagcagtactactctgcttccaatattccttttcctttttttttttttttttgagactgggtctcgctgcgtcacctaggctggagtgcggagtgcaatggcacgatcttggctcacctctgcctcccaagttccagcgattctcctgcctcagcctcccgagtagctgggattacaggtgcatgccgcaacgcccagttaattattgtatttttagtagagatggggttttgccatgttgtccaggctgttctcgaactcttggcctcaagtgatctgtctgcctcagcctcccaaagtgctgggattacaggcatgagtcactgcacccagccctgcttccaattttcaatacctttgtggacctttattctacagataactgaagttcagaaagataaaacaagatgcctaagtttatgtaacagctaataggtggcaggactgaatatgactcaaggcttctaatttcatgtccactattcttcccatcaagctatatattatgtttttgtttgtttgttttgagacagagtctcgctttgtcacccaggctggagtgcagtagcgcaatctcggctcactgcaacctccactttctgggttcaagtggttctcctgcctcagcctcccgaatggctgggattactggcgtgtgccaccacgcctggctaatttttgtatgttcagaagatctggggtttcactatgatggccaggctggtctcgaactcctgacctcaagtgatccacccgcctcagcctcccaaagtgctgagattacaggcgtgagccacagtgcctggcccatcttttgtatatttaaaacaaacaaacaaaacaaaaaacaaaacaaaaaacccttggaaataaaatatttacaaatttccaactgctcagttatgagctttactagtcatccaacttagaaatgagaaatgtatctgtatagacatgaaatttcagtaagcctatcatttctggactttaaaaaatgtttttaattaaagtaaaagttacagtgaagtgcacacatcttaagggtacagtttgataaatttgtccatgtgtatacctgtgtaacccctgcccggatcgagtatttctggacattttaaggagctacactatgaaattgtaagcccaggtgcaaagcaggagaatccagacagcccatgcacatcaataaagagatgtttatgacacaaaccagtgagctaaggctatggaaatctgtcatttttcccatagatagctacagaagcagcacatcactgttgggggagacactcgagaacaatctatcggcctcttgtggagcctgggaccctctcacgcacagtgaaaatcttccttatagtaggaagtgtgagattagcaactgtaaatatttaacacagtcctcaaactatggaaagaccctttctcagagcacagactgattatctggaaaaaaaaaaagaagaaagaaaagtgacattgcaaatacttgttaaaagtttaagttctctcccactttttttttttcctgttttgtgtttgtttcctgtttctactaaagcccagggagaagccgactccccacagcctcctctagctgtgtcccaaaagagctaagacaatagagaaagcatcaccactggcctgagaaagagaataaaagggatgggaacaccagtcccttggaatgactacttggtgcattcatttattcaatggttactgaaggatcccacgactcaggcactgcccttgggacgcatcagtggacaaacggtgcctccatgatacatgtcctagcagacaaggtgactgggtggtgctaagggaggctccactgaggcaccaggcacctcctctgccacccttcccccaaatgggtcaacttggagcccgatccagtcattggagaatcttgagggggagggcagcaggagggagagtggactgtgacccggcttctactcccagcacttctgacaccaaatgtgggtgtcacaccaaccaattctccagccctccagacaccaactgagtgtcctacaactgaattcgattctgaccctagctacctggagtcagagtcagatcccacaggttatgggctcagttccacaagcctcccccacttcagacaccaatcacaagtccaggctgcctgtactctgatcgttcacttgaaagggatgggggctacttcccctctcctctggtttcataatttgctagaatggctcacagagctcaggaaggcagttttttgttgctgttgtttttaagacggagtctcactctgtcgcccaggctggggtgcggtggtgtgatctcggctcattgcaatttccatctcccagattcacgcgattctcctgcctcagcctcccccagtagctgggattgcaggcatgtgccaccacgcccaggtaccttttttgtatttttagtagagacggggtttcaccactttggctaggctggtcttgaactcctgacctcaaatgatccgcccaccttggcctaccaaagtcctgggattacaggtgtgagccaccacacccagccgggaaggcacttttcttgcatgtacttggttattatgaaggacacaactgaggaaccgccaaatggaagaaatgcttggcaagatatggggtagcagaagggtgtggagcgccacgacttctccgggcatgtcaccctcccagcaccttgatgtgcttaccaacccagaagttctcagaacccccttttttttatggaggttccactgcctatgcacaactgattaaatcattggccgttggtgattggcccaatctccagcccttttcccctctgtgaaggtgggagtggggggcctgaaaggtccagcctcttatcacacggctggctccctggcaaccagccctatcctgaatctatctaggggcccatcaagagtcactttattagtataaactcaggtacgactgaaaggaacttgttatgaataataaaagaccctctcatccctaacactcagatattccaaagattttaggacctctgaaccaggagcccaaggaaaaaaaccaaatacatatttcttcttatatcacaatagaatatgtggatattatttggcaataaattttatagggaataggaagagtcagaaactcatttctatttccagagttccatctcattgcaatcacaatgatcaaagtaaggttaggctcagagaggaaaggcatccttaactgtgcagcctataaaacactcaccggtttttggagtcgtccagcaatgtataagttattccagttgaggagatcttcaatcagaacgttagtgctaataactccatatttgataagctgaaggaaaaaagaaatggcacaaaacggagtaaaataccatgttattgcttatacaagtataaaatataaggaaacagataaaattcttgaccagagcagtaccttgattccaaagccactcaaaacacctgacttgtgaaaacacacatctccaccaaaacttttgagaggttaagtgtccaagactgatttagcccctagggtatgtaaggggaggttgcaactgtcttcacaagattataacagagaagtctagcatggctgactccatcttgctgccagcctcacaggctggctatccaagctcatgcctgggcgtaggtcaagccaaccaaggaggaggaatatagtttatagtttaattttaaagcaaggatgataatagtccctccctaaaactgttcccctccccagtccagagctgaaatcccctttgtaaaactaatgaaagtccacaagattagggttatgggaagggcctgaattctgctaaaatgttgggatagtttctatgatgtcttactgctcaggagacatgtgtccagaggtcacaagacttgtgagttctccaattaatcctatagataacatcactactgtagaacctaaggttggtcttttgagatgttttcagacttttgcattccagcaactgactgaccccacccagaaccatgactcaacactcaattggtcctgttgcccctccctcagcaaaaggcccactcagcccatgaggactgttttccacacctgtatgattgcatccccaaccaatcagcagcacccattccctagtcccctgttcaccaaactatccttcaaaaaccctaactgccgagctttcagggagagtgatttgagtgacaacaccagttctcctgtgtgcccagcctcacgttaatgttaattaaactcattttttttttttttaagatggagtctcactctgtcacccaggctggagtgcactggcgcaatctcagctcaccacaacctccgcctcctgggttcaagccattcttgcacctcagcctcctgagtagctgggattacaggcacgcggtaccacatctggctaattttttgctatttttagtacagacaggatttcatcctgttggccaggctggtctcaaactcctgacctcaggtgatccactcgcctcggcctccaaaagtgttgggattacaggtgtgagctaccatgcccggcctgattaaactctttacagcaataccacagtcacagtgaaccgattttgtccatgcgacaggcaggaagaacccaccaggcaattacaaggtgaccactatttcaacttaggtccatgtgatgttaaaggtggaatggctcttagatgctatctagtattggtcctcagtggattgggagtaaaaaaaacttgtccttccccaaagacagtttgagaagtgataatttagttcatgttcctcatttgagaaataaaaaacctaaagctcagagacaacaaatgacatgctcaaggtggcaccagtagtagcagagtcaaaactaggtcccagaatttcagtctggtcttccaatgctcttttcattacaaagtacaagaaattttcctttaattagaagttttcactgacatgctttacatagtgaatttctcttttgctactgactatttcaaacacttttgtaattacaaagcaatatccaaaaataaaacttctttattcatgctaaaaaaagaaattatagttcagcccatttctatttttttttttttttttttttttttttgagacagagtcttactctgttgcccatgctggagtgcagtggcatgattttggctcactacagccctaactccctgggctccagtgatcctcccacctcagtctccagagtagctggaaccacaggcatgcaccatcacacctgactaatttttgtattttttgtagagacagggtttcaccatgttgcccaggctggtcttgaactcctgggctcaagcaatccatccaccttggcctcccaaagtgctaggattacaggcatgagctgccgtgcccggacagttaagcctatttcaataataatttgtataaatcctgtagatttcccaggttacaaagtcccatttgcataaacaagtatcttcagacccactttgctgaacctcagtatccaaacagccttctcaggctgcaaatatataaaaagcagttaaaaattatcaattaaaaagtagtcttttggcatataattatgcccaaacatttggttactggaacttataatattctttgaaaattactaattacaggtaggtttggcataatattaactgtggagaaagaacaaagctaagtgtcctgcatgactcaagtggatgcagaaggctgtgctgagtgtcagccttttccccccaactccagcagcagcactgcagaaagcccttctagctgcaggcaagtaaccactgggaggtaacagaaacaccacgggcctggaagtcaggggacctgttgcaaactagctgcacaaccttatggaagtcatttcctctctctgaacttcagtttcctcaactgcaaaatacaggtgaagcaaggttggatctcaaccggaaaagcaaatatatggcccaaggggtatgcagacgtcaccagtcaatcacaacactcactccttagccaagttcagacagaccttcaaatccttctcaagtcagtactccaacctcctgccctttaaagcgtgggcctttgaccaatggcattggcatcacttgggagcttataacaaatgcagaattacgcctgtaatcctagcactttgggaggccgagacgggtggatcacctgaggtcaggagttcgtgaccagcctggccaacatggtgaaaccccactctactaaaaacacaaaaaattagctggacatgattacagtagtgggctctgtaatcccagctactcgggaggctgaggcaggagaatcgcttgaacctgggaggcggaggttgcagtgagcagagatcgcaccattgcactccagcctgggcaacaagaacaaaactccatctcaaaaaaaaaaaaaaaaaaagcagaaccttggtggggcatggtggctcacacctgtaaatcccagtactttgggaggactgtttggggtcaggagttcaagaccagcctgggcaacatggcaaaaccctgtctctacaaaaaatacaacaattagccaggcgtggtggtatgtgcctgtagccccagctacttgggaggctgagacaggtagatggcttgagcccgggaggcagagattgcaatgagcggagatggtgccactgcattctagcctgggtgacagagccagaccctgtttcaaaaaaagaaaaagaaaaaaaaaaggcagaatctcaggttccatctcagaccaactgagtcaggatctgcactgaaatgggatctccaggtggctcgatgccggccaaagcctgaccgccttgaacaatgagtggcagagctggcacagcaagtgaaacccatatgtcatccctggcccagggaagctctaggaagcatctgatttagacccctactgatccttgcaggctggggttctgcctaggtcttgacagctctcttggagactgcgatgcttcagctgaaagacagttcagcaaagttcctgctgtcagatgaaccaccagcaggaatccatgcaacttacctgctctccaacagcccactgtcaaattccacgcgtctcctggcaccaagaggttcccgtctatcacctgacacacatgctctcaatcacctgtgatatcctcttcacttccaacttcttcctgggggtgtctgcccctccttctagataaaatcaatctccaacctgacccaaaattggcctgcctattcctcccactgaccagaccaatggttctagaccagcagcttcagcactgtttggaagtgtgttaagagatgcaaatcttcaatccctaccccagacctagtgatcagaactctgggggtggggcccagcaatctgtgtgtccaatggacacacaacctaggggattctgatgcacactaaaacttgagaaccacttggccaaagacaaaaaaataaagtcagtgtggccgggctcagtggctcacgcctgtaatcccagcactttgggaggctgaggcgggcagatcacctgaggtcaggagttcgagaccagcctggccaacatggtgaaaccctgtctctcctacaaggtggcacacgcctgtaatcccagctaactgggaggctgaggcgggagaatcacttgaacccgtgaggcggaggttgcagtgagctgcgatcacaccactgcactccagcctgggcaacaagagcaaaactccgtctcaaaaaaataaaaaaaataaaataagtcagtcacacccaaccacctcctcacactgcaatgacagttaatgggacatgaggaaggactccagtccctgctctgtccccaagttcaagacgtctggcaggagtgtgaatgtttcctgactataagaatatacatactataaaaacatacatatttcccgactataacaacgtccagcaggagtgtgaatgtttcctgaccacaagaacatacatatttagctggcactctaataacccaggtaaataaccagccaagttaagacaaaggccagcagtcacttaccctaccattacacatgatcaatgaattgtagtaaactccagcgccatagttattctggatggacgtgataatcttgggccctaaaacttttaggaaagagtagtgactccaatttttcttcaggttctttgaatgccatgcgacagggtcatctactgtgaacacaaagtccagcatagcattctgtggagtgaagaaaagagaataatttcagtattaattcctagaaaggcagcaagagagcatggaaaagctctaacatactacgcaattatgatcaatagtcagaaggcctggtgctgtcatcagaaatgtgagcgagtctctggaacaaatatgagctttgttttcatcaatgtaataatagcaaacacttctttaacatgtattgttgtgccagcactctttaaacactttatgggtaacatacgcagtcactccatttatcctcagcacaaccctacaaggtagctactgctattatctcaattttataagaaaccaaggcacaggggatgctctttgcccaaggacacagagcttgtgagtggcagacctaagaggtctggctccaaactgtgtgtgctgaaccactgcactacactgcctttcacaaatgtagctaaatgtgctccgcttttcttctggatcaaattagcaccacctggataaactctacaaaatactatataaaaggaagtcagttattttatctcttacctattcaccaaccacttattgagtacataagtaatgaactctgacaggccctagggtagaagtatagagctcagagtctactggagagaataaacaaattatcactacattgacttgatagaggaatgcaaaatgtactaactgcactcagcatagggatcagatcaggggcacaggagggagaaattctcctagagatgacaaatctgagtcttgaaggacacgtgagttaaacagacttgctggaagcactgggggaagcacagggaagggtagggagccgtgttggaggaaagtgctctgtggatatgggagccagcatgttctggaagctgccgtcagatatgactgaaatagaacacatttatgcggtgggagatgagatcagagagggaggctgtttgccatgctagaaaattttcctgcagaagagctgactggagagaagagggactaagggggtgggggaattagatctgaagccatggcaagattccaggggagaaatgaaattatattagctaaggcgctaaggatggggactgatgtgagaaagatgtaggtgttggaatctacaacttgttcacttgaatgtaaggaatcaaaagtgagggaatgggaaggaaggaccttttcttgcagggaattccaggtctattcaaaggaaaacctccatggaagaatgaagaggtggccatcaggaggctaacgcctgctctgtagagtgtgactctacagaccactggggacacttgagatttggtggcgaggcaggtatggaataaacatgttttttaaaaatgtgtaattatgttaaggtaaattcgggaaaaataactagcctataataacctataatttctcatatgctgccaatttaaagaaaaatattaaatagtagtgtaagtgggaaacagaggaaatccaagcaacagcatagatggcctcaccaggaagtgaacaggcaggatgttaatcagaagacagactacagtcaggtatccagacgcagggggccccattaaaacctgcacactgaattctgcaaattacaaggaaaactgtacccttactgaggctgtgctgagccaactctgaaaagtaacaatgcctagtctcaaacagaccgttgttaaaagtgctgagcgagggtaaatacactggtcacgcactaacttttgatgttagttactttcactgcacctgccctggccctacaaccagtccgccaacttcctgaagtcagaagatcattttgcattttctcctacatttatagaggtgactctcaacaaacttggctgcgcattagaatcacctgggacgtttcttaaattcctgaagcccaggcctcatcccaaaccaattaaatcagaatctccatcggcggaagccgagcattaggattttcttaaaagctccccagaaaattccgatgtccagccgactaaaacactgaaagaacctgataacgatttcttttcctttcttccatttgcccctgcagcagtttttccttctgcctaactgcttctcctgctctagacccacgtggattcctaagtatccttcaacaccgtcgcttcaactcgcgctgtcgttatactaggaaggcaggcctatggttcactctgctagtggacacgtggagtgtgcagagcggacaggcagctctccgactctgaaggaatcgagggcaaaacgggactcgtgagaacagacagttccccgtcgtggggctgcccgggctcaccttctggtctgaactcggccctgcctggcggtacaccccggagccgtagacgaaagccagactcagctcctcggggaagtgagacaggatcttgcggaaggtcacccacgagctctgcagcgtctgcagcgccatggggtcgaggctaacaggggacactcagcgcagcagggcgaggacaaccgggcggggaacagacaccgggtaggcggtttagggtgggaaatggaagtcggagactggatcgagggacacaaggctgagtgtggggtgggactgcaagcacacgcaaggattggggcgttgggccacgaagagcagcggcgagaagacgcagcccagataggctcgggtgggcggcggtcgcacaggcagag

SEQ ID NO: 2250 - DNA, 427207 bp, Homo sapiens
attatttaaagcacatttttattatagataggttaagtgtggtttgctgtggctaaagatatatttataatggatgaacaagcttttctagataccaagaggtataatatttttctttcagtattgaactaatatttctctgataacaaggagacattgaactggctgagcctattttaaatgggaaaagacttttttttttctggatgttgctttaaagactggtaaattaaaaattttaaagtactaacactaaatttaagtacagtgaaagaaaatcaatgaatactacaaaacatataatttctacaaagcagaaatataaaggttttataatttaaaacagcagcaatttcaaaaaatttgctgaattaaaactttacaaaatatatatacactaagtatcattccagatgatcatgaactttaaaaacagtatggcacaacccccaatctgtaccccaaacctactactagatgtagctggcctataataatttttacaacaatttaaaaaataaaacaaaaacaaagaaatctaattcttttgcgtacaagcacaggttacaatgtgctggctttgattccaaatacacaaagagaattttaaaataaaacaaggacttcacataaatagtttcacgtgttattaagtgtgtgaccaaacaaattaaaataagtactaacaaccaaaacatatcttgatgtaaccagtacatacacttttaaagaatgacaaagatgaaaaaggaaatagtctatgaaagccataagcaccttgttttcgaaagagcaccaagcaacacaaagaggcaacacgtaagaggtagtgtatcaccggctaagatgtatatgcccatcggggacctgaatacagcttagtgttttggaaaataagacatattagactgtggcttgtaatttttagacagaagcagtgcacatctggaagcattagccagtattgctccatagtgctctgcatctccagctgtctaatgggtactacgcactcagtcaaaaatataagataccctgaagaattccatatttataaatttttagttctagggaattctctaagaaagctgagatgaatataatttttaaaagaattaaatactttatcaatcatagtcctttaaaaatgccttttctccttcttaggaggaagtctgttcttcctgagattctttaagatttagccaatgctttattacatgcatttcataatgactgtatctgtctgtcttatttctccctctgcagcaattacctggccaacagcctgaattcggaactaattcagagactttacagaaagcatacagaactgctgtcaatgtaatactttcgttcagttttgagatgaggaagtttttgtacttcaatcactggaagttgattaggttcctgggtgtgaaaaagaaatgttgccttatgccagctgccatcttgaatctgtaaaataagaacaaaatgctttcatacgcatttcattagcagtcactttcagtagacaatgcctttcacagataatgtgaacttgttttaaggattagagataacgaatagaaagtgcctagaacaatgctcaataaatggtaaaattactattattagttgaaaacctggacttattcctttctctagaatggcactgtctgttctaatttttcacttccagaggctaaggccaggcttctgcttcaactgtctgtgaattattggaccagatatgaattaaaaggctgcaatactcctaatatgagtaataaccatctgttctgtattcctttatttgggactgatacctcaggatggatatttttctttgataaaagggaacgagctatttcaacctctgtattttaggtagaaaataaacagaatcacctcagtcagaaatagttaaaattataattatgtgcaatcatcttttaggtctcttcccccccgccccattctgtagctctctatttatacagtttccctctttcttctcttttgtgtctaataaactctgtggaacaaaaacatatcataagatatcctgtgattaagattcaaccagacacaatagagaaaaacaattgatgagttttgtggagctgttatttaggagctaattcacttattcacagaattatcatgatataaattttaaattttgaaggaactttagagattatttaagctataaattttattttaaagttaaggcaattgaagctcattgaaaataagttacttgtctaaagtcataagcttggtatgataacaagacctaaaattctgtgtgtgaggcactgttagattcattcattaagtcttttaagcaatatttattgaatactaagtatatttagcatagttgaataagatgtaacacttagtgttcttatagtgcttgtgaaatacacgatgaatacaatagttctggcttctaaatgctagtggcttataaatctaattgaagagagtaaaaacataaacaaataaccacaacaaaagaccatctatagaaagtacaatgtaaaaaatgtagatagttagtaaattccacatttctaactagagtactcagggaaagcttcatgaaaaaatttggaatatagatgggctttaaagtatgcctaaaatttccacttgattagtgaggtacagaaaggcatttcagagaaaatgaatggcttaagctgaacacccatacatatacacacacacaacaaccaccacaaaaaactaaaaaacagaagggcaagtagaaagtggctgtgaaaattagcttagcatggcgtttaaattcacggatttgacctgggacagattttgatagaaattctggtactctcactttccccacatataaaatgggaataataaacacctacctcacaggcttgcgaggattaaatgaagtttcaatcaaaagtcactagcagtacagtaaggcctgggctttggagttctccatgcctgggattgatttcttttcttttcttttttttttttttgagacggagtctcactcggtcgcccagctggagtgcagtggtgcaatctaggctcactgcaagctccgcctcccaggttcacgccattctcctgcctcagcctcctgagtagctgggactacaggtgtctgccaccacgcccggctaattttttgtatttttagtagagacggggtttcaccgtgttagccaggatggtctcgatctcctgatcttgttatctgcctgccttggcctcccaaagtgctgggattacaggcatgagccactgtgcccagccatgcctgggattgatttcttgttcctcctctaattagctgtatgactgcgattatctaattagctgcattactttaatttttatttattttttactttaatttttattttacttatgctaattttacttacttgcgaatttatttttaattatgctaattggctgccttactttgctcaaaataaccttgagcaagttctctgtgcctttactttcatacctataaaataggaccaataatatattctttacaaagctgttattatgaataaaataattaatgtaatgcatggtcacttaacatataataaaactcccaataaatagtagtaggagctgttgatattattatccctattattattgtaacagatgagtttgaccatagtttacaacagacagccagtgaaagcccaatctagaaaagcaggctggggtctggttgttgtaagcactcaatggagttgataagtttgaattgtgtctcagaggtactagtgagtcactgaatgtttctgggcccaactgtacaagttaaataaatttgttgatgatactcatctcttcaaatatagataataaaatatatatacttctatttgcttatgatttttcaagcactattttcctggaaataaaatgttatgaaaaagtagagtaacttggaaatgttgagatactaaatcatgggtttcatagtacacaaagataggaaatgaagctacttaaaataattaatgatacatatataaagtgtacaactccattctctaaaagaggggtcggcaaactcttctctaaagggccagatagtaagtattttacattttgtgggccctgcagtctctgtcatacttactcaactctgccattgtagtgccataacagccatagataataagtaaatgaattaaggatggctgtgttccaataaaaatttattcacaaaaacatggagtgggcccgatttggtctgttgaacatagtttgccaacacctgctctaagaaatagtgttttaaaattatagatttttcatagtaactgtcatttaatttttttttttttttgagatagagttttgctctgttgcccaggctggagtgcagtggcacaatcttggctcactgcagcctctgcctcccaggttcaagcaattcttgtggctcagcctcctgagtagctgggattattggcgtgtgccaccatgcctggctaatttttgtatttttagtagagacggagtttctccatgttggccaggctggtctcaaactcctggcctcaagtgaaccacccgcctcagcctcccaaagtgctgggattacagatgtgcccccacagtgcctagccccattatttaatttaatttaatttaattttttttttttttgagacagagtcttactctgctgcccaggctggaatgcagtggtgcgatcttggctcactgcaacctccgcttcctgggttcaagtgattctcctgcctcagtctcccaggtagctgggatcacaggtacctgccaccatgcctggctaatttttggatttttaatagagacggggtttcaccatgttggccaggctggtcttgaattcttgacttcaagtgatctgactgcctcggcctcccaaagtgctgggattacaggcatgagccaccatgcctggccccactatttaattttaatggaaaaaaaataggccagaattcaaatacttactggtggggccagtcaatatgtaattatacccatatttggtatcaggtacagggattgacagaatgaaataaaactcacttgcctctataacttgccttttatgcaataatgagatgtagaattacagcagtgaaaacacatgaaaatatttatccaaatacactatctatttatcatttatctatctgtctatctatccatccatccatcctggtataattatttcatatagggaataaaaattaaatttacatcttaacacctgttttgcatgcaaaaatctaagaccaattggtatgacacaagttgataaggtattatataaacaaatgattgattctagaaaatgcagttacaagtcaggcacattaaaacttactacccttctgtatctgcagtttgtaattaaagtcttactctaattatcctaattttatggttttatcaattttaagttagttatattgaacaattctaaaagtgccatttccttaccttgcagtcatctgaaagcactttaggttcaagtagagtgtttactttaaaaatctggccattccatcccttgaaaccaataggcaatcctgggccacttgtttgtgtgcttgtccaccttggggtgtttagacagtgaatggtgatgatatgggtggcttccgaactcagtaaatgaaggaagttcatctggactttcccaactccaaactccaactaatgtcatagaaatgatatgcaggttataacatggcaattgagaaacttaacagttcaggaaaacctgaggaaaagtccttcaaaggcagcctccagaaagctcctttccttggaactgaagtgccagtcagtggtgtgctggtaaatgtttaaccactgcttcttggaggaaaaaccatgatttatagtatttcctgactcctgtggtagaagcactcccaaagtgctgggattacaggcatggctgaattcagactaccaaggtgaggtcactgaacacggcaatgggaagaaatgttaacaagtggctttcctgagcctatatgaattggctccagcataccatcaggctactacatataatatcaataaaataaagataattttcacagtatataaagtaacaatttgcttttggttaatgctttaatactttttttaataaaaatctgagattctgtctctgccttcgagattttttttgtgagagtttccaaagatgagttacaagctgtaacaataatttggttgagtaattttaactttgagagccttaacggactaggacagaatcctattctttgtgttaccagcccttaatgtagtttcattcacacagtgaatcgtcaataaatatttattgaatgaatgaatgaatgcataaacaagtattaactaatatatatattagttaatatataggacaatatcagacttaagaagactgactgcacgtttcccaggcttgaacaggaaggcagattttcctatagctctagacatgattattattattttagcattattcaagcagggatatggtcataatgtaagtgaacagaaatagttcctactgaggaatttgtactgatttccaagcataaagttagaaaaatatcagttatgaggtaatgtagaagaaaaacaataacaacaaaaagaaaaacagaaagaaaaaacaaaatgagaggaaaggcaaaagaagggcatacacatggaaagataataaggaacattagaatttaagtaattcaattccttcattttacagattagagtcagaaacttgcaaacaatatttaagctttctgagccttaatttccttgtcagtaaattcgggtataacactaatctggcatggttgttatgaggattaaaaatgacaaatgtaatttacctagcattgttcctggcacagagcaggccctctggtggatcacagttttattccctaggttcatagaatagagactagaaccccagtccctgattccaagtctactgttcatcccagtacttctctggtcttccttgggttgagtttatgaatcaaagaaattagagaagtgatttggtcatggaaacaactagagtccgcttccccactgctcctatttcctctgcacagttcacacagccccatcttctttccttctatgataatcctatgccaacttccactggaatgaggatgatgatgtggatattttggaagtaggactatcatgctgctctttattagaggttcatgattccctaggaatggaaggatccttccctcttctatttcaggggtaataatggtgaatgcctattaagataaattgatggaatgccctggttaatgaagagaggtgttttaggaggagagggcggttcaataagaagcagctaaagagattgaattttatctgctgtctttttatgatgaacaaaacacacaataggcacatgtatcagttctttgtcaatgagaaattcttgatcatatatcaagctggtttaatcagaaaaagaaagaaacatagttttggtttcaatatatgttataggtacagctaggatttaggttttataaatatttgttataactcccagtgttataatatatgttagtttaacaaactaacatgcattcgttctaaacgtttgatttatagaattattcatgaaagaagtttttagtagtattctgtggatgtttaagaaaggttattatgtgcccaataaccataaatagcaagattttgtggcaaattcttttttaatgattataatataattttcagcaaaacttcaggtaactgattactggttacaaacactagctgtttaagaaatttctaatgtgtgtgtatgcataaaaacatagcatatgttgcacaattttaaaaggaatttaaaaaacatgatcagtagggtaaggcaaactaagccaaataataaaaagacacaatcaaaatgtcaagatttactgtgattaactagttttaaaaaataacatatttatttctcatacacaatagagaataatctttgctttcattcttaaaattcataattatttaaaatgatagaattttaaacataatttttcactgatactgtgcaatataacgacatgtgttctaaaattcagtaacatacctttgttacagaaacaggaggtaagcatgtctggccaccagcactgaaattgcagaaaacctcaatggcatctgaaggacagccaagatttgggtcaatccagtattttcctaataatttatagtaaaacataaagttaaagttattaaatgccataatccttataatttcttttttttttttgagagagagagtctcattctgttagcccaggctggagtgcagcggtgcgatcttggctcactgtaacctccgcttcctgggttcaagtgattctcatgcctcaacctcctgagtagctgggattacaggaatgggccaccacacccggctaatttttgtattttcagtagagatgggatttcaccatgttggtcaggctggccttgaactcctgacctcaagtgatctgcccacctccacctcccaaagtgttgggattacaggcgtgagccactgtgcccggccacatccttataaatggtcatggtactttaaatacatattatcacagtttcacctgttaaaaacttagaagattatatatttacatttagtgaatgaatgaatgctgcattatgtaaaattgatactaaaaatgctgtatttttcacataactatcaatttcagagtgtttcataattttaatcaattatgattaaattatgataaaatgatagaatagctgaattgattgcttcattctacagataagaagatgtgctcagcaactaaaagtgaattgtttagttacatagttaacaaaaaagttgaacttaatgaagtatatgtgtatatttctgttatacatcattacagtgtttcaaacgaacattttgttttataatagaaacaacttccatctcttgaaggaaaaatatatctttatgtataatactgataagtaaaataaaaatatgagaacatttttgttttcacaaaaaaatcatacaattaaatgtttatcatttttgtactctttcagattttcccactatcactcagtgggaaaaactgaggtccctatagctagtgaaattctaccagtctttgctccactgagtgcccaagagaataaaactgggcctaaactcagactacagaaaatacttagactgaaaagcaatggcctagcatcttaattccagactaatagactgagagtattaaaatagcatcttattccaaatacaaaggacaggaatttttgaataaggcagccctgttttcctgcattaaaaacgcaagaacattcaatggtttttgttaaatgtcattttttctacagtaggcagaagtccttgttcattccacttttattccatagcaaagattcctctagctcatcctgagtttcctctagcttctaaaacatcctcaaatattctcctctctactattctactaatccctctaaatgcttacttgcttaattggtagctcaaagggtagaaatggtcctcagctgcagcagtgttcaaactttagtgtgcatcaaaccatcactaaaacacacatagctgggccctacccttgagagttgctgatttattaagtctggggtggggcttaagaatctgcatttctaacagtatctaattctggtccagggatcacatttggagaaccactgatatattgaaatacagaagaaaggggtgaaggaggtcaaccattcctagtcccttatcttcagaattttgaatatttcataaagtttttagaaagtacagctgaatttttcatcagaatctgatgagggcttccagtcttacctaatggagtaaacatatatcttctttcaccttctcttgtcttccaagaaatactatcctactactatatgagctaataataaaaaattctttataaaaggttttccatcaagcaaattttatttttatatggggtgaaatgctttgaattcaggtgttatattctatttgggtaggggctccataatttctttcaaggtatgccaagctagagatgaagtcctataccatgacatatcttttgtgagcctaaatgttctgactcaaaactagctcttccctgaggacactgcttctcttgtagcctctacagtgttgtgcccgaaggtggcaaggcatctttcttgctctttgttgctacttacagaccattctttgcattttctccctgaaaacactccatattgaaattactataatcacattatatcattcattagttcctcctggtgtaatcatttactatttttctatgacaattttagctttttatcactttcagaaaatctacttatgacctaattcttggtgattttaaagccacatagatgatgctttcaacatgttggtcttcagttccttgaattgtatcctccccaaccctcttacttttccaccaatgatcttgtaccctccccctaccctcgtaccttactttaaccattaacttccaaggccatatcctagcttttgttattaccaacaactgcatctcctccataatttcatttctcttctctttccagttcactccctctagtgtcctaactccaataattcttcactttcatcgggacctactatcactttttcattgcccctaatgatcatatgttcacttcccttcttacccagcttaaaaatccacagtcctttactatagtaatgtccttataaacttccttacacccttgccctgcctcatttcactctacttgtcttataaatccccaatcctacgtaagtttctccctaacctgtgcctatacctgcacagaaaaaagtggtaggagaaaaacacaactgttgtgatgggcatccttcaaattcaaatgtgtctgtaaagctgctagacagtaatatggtgtttccagagtttattccctctatcactaagatagttaactatcttacacctattcattcgctcttatcctcaactgataagcttccaatttcaatgagacaactgaaggaatctgaagaaaatttatgtaacttatataaactcccactatcatatctacccacatgtctgtgcttgtacacatatattctaccttctctctctttttgaaataggaatttctctcttgctctgttgcccaggctggagtgcagtggcatgatcttggctcactgcaacctccaccccctgcaggctcaggagatcctcccaccttagcctcctgggtagctgggaccacaggcacattccaccatggctggccaatttttctatttttagtagagatgaagtttcaccacgttggcctggctgttctcaaactgatccgaaaaaaatgttggcctgaagtgatctgtccacctcggtctcccaaagtgctgggattacaggcatgagccattgcacctggcctgccttctctcttattatagtgaataaactgtgttcctatagaagaattatcctaaggccgggcacggtggctcacgcctgtaatcccagcactttgggaggccgaggcgggcagatcacgaggtcagcagtttgagaccagcctggccaagacggtgaaaccctgtctcttctaaaaatacaaaaaaaaaaaaaaaattagctgggcatcgtggctggcgcctataatcccagctacttgggaggctgaggctggagaatcgcttgaacctggaaggcggaggttgcagtgagccgagatcgagccactgcactccagcctaggcacaggggtgaaactctgcctcaaaaaaaaaaaaaagaaaagaaaagaaaaggaaagaaagaaagaagacttatcttgttcattatacttgcagatttaaattctacttcttttctctcttttgagtctgctttcgttgtctgctgtttctactagttctcattcatggtgttgtgtcaacttgtgtgtttggttgttgattgtgtgctgggcactgcatttttgaaattatttgtggaaatagtttgagttctaggaaaatgttatcttttatagaagatttttgtttgtttctgacagtatgtgggagttccagcagtttggaaccattttaatacaagttcaaagtttgggattttctgagctatccagatgatgtgaagcaaagctacagtctgtatgaatgttcgttttcttccagtttatctttactactagaatgcaggcctttgaaagtctaagtcctcacctttggtgggccacagattctaacttttgacccctacctcctgaagccaccaagcttctcaacatactgggggcaaaagtagctccaaatgttgggttcactttctgctgtctcctttaaagtctcagcttgaaagttcattgctgtttgttatttattttatgcttttaacttaaaaaattaatttagccaggtaatatgaattatgtgcttcgttactgggaatgaaaagttcctagcattatccttttctcttaaaatctgataaggttttaactactaccattcctctaaactgctcttgatgaaggtccttaatgatgtctgcattgctaaattcagtagtcttcctcagtttttgctttacttaacgtggacccagttaatcccttccctccctcctcctctggcaaacattttctttgcttgattttcaggacaccacatccagtttgcctcttatctcagtgatagctgcttcttagttttgtttgctagttcgccctcaccttcctgatctttaaacattagagaaccctaggatccagtttttagacctcatttcttttttctttttttttcttttgagacagagtctcactctgtggccaggctggagtgtggcggtgtgatctcagctcactgcaatctcggcctcctgggtcaagtgattctcctgcctcagcctcctgagtagctgggactacaggtgcgtgccaccacacccggctaatttttctgtatttttagtagagatggggtttcaccatgttagccaggatggtctcaatctcttcacctcatgatctgcccacctctgcctcccaaagtgctgggattacaggcatgagccactgtgcccgtcctagacctcatttcttcctttacttactatctatgtagtcttaagcagtcttaaggcattaaacaccaattaaatgtaaatgatttcataatttttacccttacttaggatctccttcttgaccttgaacttgagtagtcaactacctacttgacattcttacttgaatgtctaagagacatctcaaagtaaatatatccaaaattttactcctgatcttatctccaaaattgcatctcctgttaacaacatcccacccttttacagaaaaaaaaaaaaaaccctgagagtcatcctttaccattctagttctctcataacccacatccaatctatcaacaaaaactgctggctctaccttaacccatttattcctgaggttgtaatttttttgaatttttgcaatcagaccttggtgatgaccttaagaagtaggatataaatgactcccacatgcttagtgttccaataatggaacgctaagcataaagcatattcaagaatctaaccactttttaccacttcccctgcaaccaactctagtccaaccaaccatcatctctcctggattatgtcaatatccttctcagtggtttccctacctctacccctgtcttcctgattgtatttgcaacatattagctagagtaatattttaaaaatctgagccaaattatgtcacttcttcgctcagcaatttccaatggcttcccatcttatcaagagtacaagctagagacttctgagtagtctagagggtcttgtataatttgactttttgatatctttctaatttaatttcctatcattctcccctatatgcactctcttccattcatactggctttcttgctaattctaaaacttgctaggtatactcaaagactcagggcttttgcatttattctttgtgcctggaaagctctttctctagatttcttgtggcttgctctcttacctccttctgatatcacccaagtgtcacattctcatagatgccttatctgatcattctatttaaaaattgtatcttgtgctccacttcctatcaaatctccctaccctgctgttttgtttttccttatagcacttatgatatcctagtgatgaaagtatttggggggcgtaaagattttttgaacactgcacaatccacaccatttagctatttctcttataaggaaggtagactttgaattacatttcatactaattttgtatgtcttacaagatctttgttcctttcaattctacagaattacactttaatgccctcaaatatgggaaaaaatcaagctgagaattattataggcaactacaattttagtattattttagtttttatattaatctagggcagaaaaatatctttagaagttaagtgtttgattaatgtaaacaaaatgaatgttttcattgaagttctagaacggaagcagatgttttggacatgtgtgtatgtgcgtgtttgtgtgtgtgtgagtgcatgtatgtgagatgtgtatgtacaaacaaaattaaaatgaccacagaataacataacatagctttttcaaatcagcatttttcacatcagcacttttcaaatcatacatttttttttcaaacatgtcattgtgttaaaactagagtttgtagcagacaaggtttcccctgtttaactgatgacttactcctcttgatttaaaacctttccttggttgttctaatctaaattcatttttgcacctctggctaatgaaatcggggcatctgtgttgagattagacacttccaagaatgacaaaccgctcccatcttcatggtcatcaattctagaaggcgacatttaaattccattttgtattaaaaaaaacccagacttttagggagtatggtgaaggagatgctataatatatttatttatgttgctaacttttgtagtcctgacttaccaagttctgatgagtactactgtctgttaatgcaaaggtcaggcctacctttcttaatttttaatatgaatatgctgtataccaagtacaaaatataagcaaatgatatagctaggggtggatgacatcagaatcatgtctccctcatagagaattttattcttgatgacattaaaatggcttctgccagggttttatcaaactaactatgatttggagtgaacacattacaaatctcaaacacactgaaatgatgaaatgaaattcactatcagagtttgaggtaaccaagaacttaccatctgatactttttgttcacagttaagtaaatctttgcagattcgtgctgggttatctcgtgtgccaagaggattcttgatgctgtgcaataaattgctaaggtagttcagggttttgaatatctcttcactgtggtcaattaaagtcacttcagtattctggtagctctgccaagtcatcataagaattatataagcaaaaaaatcctgaggaccaacatgggccaaggcaggagaagaatgtgtttccattatgtgtagtaagttgtgagtagaatgtaaagaacagtttatatttaagcataggcatatgtgtatgctttaataaccttaatcttttaaagaggttaaattcacatttgcaagtttagttttcaagctaacataagaattgctatgtctactgtattatgttttttaaattacacattgaatcattagagtttaaataaatgagtagtgataatatatatatctcattttaagaaacatggctaacctcatttaactactttcttggatagtaccaaattccttacaaataacagtactaaatttttgatttaaatgttttccttacaaaacatcctacgcatatatttctgtttaattataccaaaatcacttactttgttcttgagaatggtttcacattttcaatctgttttaaatacaatctttgagataatgtcacattttggcctccaaaaattttctctgtttaattggtatattgagagacagtgccaatataaataaaaccagatatgttacctccatctgtagggcagtatttgattcaatcaaggcttgaatagcagcattgatatccatttgcttctgtgtaaaacaaaaccatttgagattagcaataagatcaacactgagtgccctaaagtaaaggctgtaaattctgaaagcactgctgttaaagtataccagacttattatctgaaggggttctgtaactcttacggttagacagattttgcaaatattgcctggatatctgaaaggacaatatgccaccttcatccaaatctcaaacgtctcctaattaaaataggaccagagtctacagtcctcagatgaaaaactatttgtttctgttgcctgaaaacacacacacaaagttcctcaaatggaagagaataaaatatgatcctctcagttaataaattgtaaagtgaagaataaataactgtagcaatttttaacagttacattcttggaaggagtagaataaaatactactgtcctgaggtagtcaccacattaatttaatctgatacttctgcggttttaaaaataatttctgaagttggaaaatgtaccatgagtcccaaaagaaataatacagaatgaaatcaatctcctcttgcatttaataaaatatatttttagaaaaagactgagcacaaccattagtaaaagtcttttttttttgtaattcttttaaaaaaattatcttagaacaatgaagcatgagttgggagaaggttctgggaaatggcatctgtgtaagtgaaacaagcaatttaatttctttcagtcattgtactgtgaagacatctttttacttgaaggctgcataatagaaactgtattcaacagatatctcatagctcatggttggtagtttgaaaaactatttgaaatgatggaataatcaataaaatgtactctcccttgcttcagcatgtgttgttcatactggaaaataattgactcattctgcatatatatactgccaaacactgtgatatatattgaggataaaatggtaaagaaaaaagaaacttgcccttatggaacttaaatttagagaggagataggcaataattaaattatctcaaaaatcctaattaccaattgagatacatgctatgaaagaaaagtgcacgaaactatgagagaaattagagaaattaatcaaatctggaaaatgtaagaggttggaaggaataggtcagggaaggcttccctgaggtagtaaaatttgaactgatgtccaaagaataaataagaattgttaggagaaggggtaggagagctttccaggcagaagcagcaacctggcacaaaggccatgagacagaaggagcatggactattcaagtagcaaagagggtaaacctaaaatattctctgcagattaaataattatgaccatcctgcttgcgtgaatgagcagattttggatatgggtcacacaaaaatattggcactaaatatgggaaactgaattaagggctaaaccatagccacctttatgttgttcacttggtcccctgctggtgattatgggttttaattagaaaacctagcatagtggttctcaaactcttcagaatcagaatccttttgcacttttaataaaggattcctttattattagaggccttacaaattttttgtttatgtgaattataactttttttttttttttttttttttaatttgagatggagtctcgctctgtcacccaggctgaagtgcagtggtgcgatctcggctcactgcaacctccgcttcccaggttcaagcgattctcctgcctctcagcctcccaagtagctgtgactacaggcttgtgacaacacacccagctaatttttgtatttttggtagagatggagtttcaccatgttggccaggctggtctcaaactcctgacctcaggtgatctgcccgccttggcctcccaaagtgctgggattacaggtatgagccaccgtgcccggccaacttttgatattgactatagtagaaaccaaaataaattttaaaactattcatgtgtcaattgctttaaaatttcaacaaacccattatatgttaatataaatatttttataaaaattaactatattttccaaaacaaaaaaattaatgagaagggtcacccagttttacacttttgtgcatttctgtaatgtctggattaatagattacagctaaattctcatatttgtttttgtattcaattagttgtgaagaaaacccagcctaatagagatatgtagtaggaaaaaagaaaagtatttaagtcgtgtttttcaaataattatggattttcttctttcatattataccttataccaaaacttgataagtggtagtttcttaaaggttagtttttgtgggaaaactgaacccacctcaatgaacgttttgtacttttatactaaaatccattggtctgttttatactttcataggtcttttgcttatacatgattttattaacataatatattgatcattctgaaaatactgatttatggaattatgcaggtcttccaaacacagatacagctcattccttaatgtcaaaaattacatttgttaacatcattaggaaaacataatgttacttatcaggaaaacataagtactgggaatctgtcaaatcctcagtgataaatacatgttttccctaatttttatttttgcttgagagcttgaaatttctcactggcatcaaattctgtcagttgttttccttgaaatggaaggctaacttcattcattttcaagaaaatatctgtgaactactcatgtcttaataatgctggtagtctgtcaataaaaaatggtactctatgataaaactggctagttgggtttgcaactcaaatagctgcacagtgcttttgaagcaatcactacagtgtgcactatatgtactttatatgtccttccatttcatctacgaaatattaaaaagatatttaaagaagataagaaatctaggagacagcaaaagtggtggaataatagccttccagaattctctcttaggcaagttaaaaaatgaaataaaaccatgtctttagaactaaaggacagagggaggagccaagatggccgaataggaacagctccggtctacagctcccagcgtgagccacgcagaagacgggtgatttctgcatttccatctgaggtaccgggttcatctcactagggagtgccagacagtgggcgcaggccagtgtgtgtgcgcactgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcactgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctttgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaagactcgagaactacgtgaagaatgcagaagcctcaggagctgatgcgatcaactggaagaaagggtatcagcaatggaagatgaaatgaatgaaatgaagcgagaagggaagtttagagaaaaaagaacaaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacgtccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaacatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcagtcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacaattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaaactctgaatagaccaataacaggctctgaaattgtggcaataatcaatagtttaccaaccaaaaagagtccaggaccagatggattcacagccgaattctagcagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaaggattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaagaactaaaggacagtatgagaaagatgtcttactaagtagagaatataataaaagcacataaattatagaaaaaagaaccaaatagaaattctgaagttaaaaagtacaatagctgaaataaaaatttactagataggctctacagtagatttccataggcagaagtaagcaccagttaacttgaagacaggtttattgagattatcctgtttgaggagtggaaaaaaaaatgaagaaaagtgaacagagacttaagagatctgtaggacactgtcaagcttatcaacatatgcatgatgagagtctcagaaggggaggagagagaaaagggggcacaaagaatatataaagagatcatggctgaaaacatcacaaatctgatgcaaaaatattaacctacacatccgagaagttccacaaactttcccagacacatcataatcaaactatctaatgctatagacaaagagagaattctgaaagcagagaggaagctcatcatgtccgagagatcttcaaccagattaacagctaatttcccataaaaaaccataaaggtgagcaggcagtaggataatatattcagggtgctaaaagaaaagacagtcagccaagaattctatttccagtaaaactctcctttaaaaatgaaggaaatattaatatattcccagttaaataaaaaccaagacaatttatcactaacataccttccctagaaaaatattatagggagtcattcaggcctaaagtaaaggatactaggcagaaacttgaatccacctgaagaaataaagagcagtagtagaagttacaatatagtaaatataacatatagtatagaccccaagtagccaaaataattttgaaaaaagaagttgttagaggcatcatgtttcctgatttcaaaacttactataaagctgctgtaatcaaaacagttggtactgtcataaagacagacataaagaatgaaatataatagagagtccagaaataaaccttctcatttatgatcaaattattttcaacaagagtgctaagaccattcaatgaagaaaggatggtcttttcaacaaacagtgctggaaaaatggaatatccacatgggatagaatgaagttagacccttaacttacatcaagtacaaaaaaacttacatcatgagttataccatgaactcaaaatgaatcaaagacttgaacataagaggtaaaactataaaattattagaagcaaataggaaaagcttgataacatttgattttgcaatgatttcttggaatgataccaagagcacagtcaacaagagaacaaagtagataaattagactatatcagaaaaaaaaaaaaacttctgtgcatcaagggacactataaagagagtgaaaaggcaacccaacggatggaaaaaaataactgcaaattgtctttctggtaaaggattaatatctagaatatttaaagagcttctacaacttactaacaaccaaaaaaaaaaaaaaaaaaaaaaaggcaacccaattcaaaaaatgggcaaataacttgaatagacatttctctaaagaagaggctgggcacagtggctcacacctgtaatcccagtactttgggaggccgaggtaggcagatcacttgaggtcaggagttcgagaccagcctggccaacatggtgaaatcccagctctactaaaaatacaaaattagccaggcgtggtggagggcacctgtaatcccagctactcaggaggctgaggcaggagaatcacttgaacctgggaggcagaggttgccgtgagctgagatcgcaccactgcactccagcttgggcaacacagcaagagtctgtctcaaaaaaaaaaaatacaaatgtctaataaacacatgaaaatatgctcaacaccacaaatcgttaggaaaatgcatgtgaaaaccacaatgagataccgcttcataaccattaggatggctgttatagaaaaaataaaccagaaaataacaagtgttggtgaggatgtggagaaactggaatcttgtgcactgctggtggtaatgtaaagtgtgtggcagctatggaaaacagtatggcagtttctcaaaaattagacatagaattactacatgatacaacagtttcatttctaggtatatacccaaatgaattgaaagtgaagactccaacagatatttgtacagcaatgtttatagcagcattattcacaatagccaaaaggtagaagcaacgtaagtgtccatttggataaacaaaatctggtatatgtattacatggactattattcagctttgaaaataaataaaattcgaatatacgcttacaaaagagatgaaccctgaagatattacgttaagtgaaataagccagtcacaaaaagacaaatattgtatgacttaacttatatgaggtacctagagtagtcgaattcatagagacagaaagtagaacggtggttgcaggggctgggtaaagggaggaattgagagttattacttaatgggtacagagtttcagttttggaagacaaaaaaagttctaggcatgggtagtaatggttgcacagcaatgtgaatgtacttaataccactgaactctacacttaaaaacagttaaaatggcaaaattttgttatgtatatcttgccaacattaaaaataacaagtaaatatgctcattatcccttagaccaaactatcctacttctggcaatttgtcctctaggtattctacaaaatgatatgtatatggacaggacatttgtactatgtgtaattaaaaaaactgaaaaaaagatgctcaccaacaaagggcaagatgaataaatcacaggatattcttagttggcaacactatgattttctgtgtgtggcagtaaataatacaatgactattagtagattagtagtgtagagtttgatgctttagtcatgctaaggtaccagcaattttaaacaccatcagtgcaggcgacaactcaataaaaaggcattttttttcccaacaggtattagaaagaaaagaaatttcataacacttggccactcaaaaattttcttgacaatctccatattcctagaatccccaaggtattcacaaagcctagctcatgactggcacatagcagtcaatcaatttgttgaatttattgactttttccccacaggcagactttaagaaaggcagggtcagagaaattgtattaagaggatttgcctgggaagtcattcagtcacatctaagtgcccacatcgaagtataaatctctcattaagtgcagtgaggggatcaaataaggaaaaataacttcttccaggcactctagttagagagaacatattcttacatggaaatcactcaatatttacaaaaacatgcatgtaaaatagaaaacagagaataaagattgattatatgttgtgactagtgagtgtgaaataatgaggggaattagacagcaggattcattatactttgggagaatgtaatcttcataattctctccaaatcattcgagtgaagagcagatctagtctaggcacctcagtattttgaagagaagcgttattttttcatatgtctaaagtttcaagatcactggatggtgaaaatgctgaccaaataggaactcatttcaggtcacacccctctttatgatagaagtttttgctgattctagagaaccagtatataatagcagcagccacttcttaattcaccaatccaggttctacagttgacccattaattggaatacatcagttgggaattctttctctcacttaatgatttttaacgattgttatttccatcatatacaccaaacacagacacatatagacaccctgttcttccctttattctactaatcatttctggttaactttgacatcatatggcatacttctgtgttcatttctaaataccttaccatacacactgaggtctggtcattaccctatcctcacattcaaattcaccatcaatacatattccttttcctgaaacatttccttttagctattccactttagagaactgagcaagttactttagtttcataggtcttataaagatgtggctggactggattagaagttttcatacttatcttgacccacagtaagaaatacatttttacatcatgacaaaattcacacaaacatacatatattcaaccttaaaaagttctgtaaaaccatatttattcttactgatgatgatgtactgatttttttaaattgaggtaaaatttatataacataaaattcactattttagtcatttaaaaatatacaattcagttgtctttagtagattcacaacgttgttcaaccactaccatgatagaatttcagagcattttaatcacccaaaaagaaactccatatctattaagcagtccctccccaatatttttctattctatttcatttgctctaaaaataatcctgaatgagactcactaaattggtcttatgatccgctgaccaatgaatcccaactcaaagtctgaaataactgcttaataattactgagaggacctctagttctatgagtctaattttttatagacattgtttctctccaagtgaaatctagtttagaagattcccactaaaatttcctgagatgttgccttttttgtattcatgcaagcatgcactcaacatttattaagagcttaaatggaaggagaatttaaaaagtagtctctgtcttcagagggttcacaatataatagaaaagacaaacatgaaaataaatgagtatgaacaaagaaggggaagtgatcagttctatcttgtagtgtgatgagggaatggaattaagaaaagtttcatggaggctgactttagaaagaatgtgtaggtgtcttattgtcatttagatgtctgctctagaaatcttatcctcaatgttattttcctacaacggactctgcaagttccaggaaaacagcattatatatggaaatctgttttcatattggccaagaaggaatacagaaaggaggaaaagggagaaaagaaggaaacaaagaaactagcatttattgagtagttataatgtattcaacacacgtattttcttacttaatcttcctgattaatttctcaaagtgtatacatattttaatccacattttgctctgagcaaaaacctctcatgtcttactctattttggctgtgtaggaacacatgtattttccaagtgagacagggatatgtgtcacacagtttggcacttaaatgtgaaaattttcactaaacatttctttaatttgccaatgacgtatgatcctttagaacttgaacttgttctttcttgagaagggagctatgatatatcaaagtcattataatttgggaaggcaattaatgagggtacttgtaatccatgcattgtggggatccaggaggaaaggaagaataaacaagtggaaagtgatttgaagacttggagaaagacattgttttttttttttttttgtttgtttgtttgtttttttgagacagagtcttgctctgccaggctggagtgcggtggcatgatctcggctcactgcaacctctgcctcccgggctcaggtgattctcttgcctcagcctcctgagtagctgggattacaggcatgtgccaccatgcctggggttttgccatgttggccaggctggtctcaaactcctgacctcaggtaatacacccacttcagcctcccaaagtgctgggattacaggtacaagccaccatgcccggccgaaagacattcttattgatgtccacacagggagagtttccctccatgttagtcagaaggccagaaaggggaagtgattttttaaaatcacagataaatgggtctcttgttttcaaggggatagtcttccttgtggcactttgcctggaagttattccttgccccaatgaaaagctgagggaaatgaagagttcctgatctgctgagagtagaccacaggaaaccaccacctagaactagcagagatctaaatgacatcagagcagcatgtgaaataagaaggcttaaatggcataggactgactattgtttgggatggtgtagcgaacagtagatccatgttaggcagaaaatgtgaccaaggaccactgtatttgaccaggaggctggaggagtggggtgtgggtgaggttgcagatggagagagacctttcatagggagcagaaagacaaacagactgcggaatatgagagtggatacaaagcataaggaaaatcaaacttagaatatcagagggcatgagaatagcagaagcaacataaacattgcctcagagataagggtagcaagttttgggtcatagtagttagataataagcaaacataagagaagtctgatggcttccagagttaccagcaactgagaaagatttgatttacttcatgtaaatcaaagaagtggataaccctggctggcaaaaagagaacatttaaaaaaggagagtgaagatgtagaattaggaagaaatggagataattagtttttcaagtgcttattatgtattatacaatgtgctgcatgctttacttcttactcaacacttgaaaccacccaagaaagcaggagataccatctccattttataaataagaagtctgaggcttggatttcatgtttgtgtagctgggccagccctgtatcaggttagcaaaaaagaacagaggtatccaaaagggataccttttaatagagagttaacagaaggatatttaaaaagttaatatgacatactaagataaaacaaaacaaaatcaaaccaagcaaacttactcttgggcctggtgctccaggtggaccctagaacacagcaaattaaaaaaaatacacatttatttagtagacatcttaaaccaggcaaacatataagcatcaatggtaaacagatataaatgaaaaccaactcactggaggccctggttgacctcttggtccttgaggaccctggaagaaatggagacaaacacaagacctatatattatacttttggttgggtataagcaagataactaatattcaacctctgtaactgcctttcgtgccaggcaagtcatacaatttaaaattgttttagtattctaaagttatatgctgtggtacttagcaatcatccatattcataaacaagctggatatttattttcctgtttatcgatattattagaaactgaatttactcattttaataaactattataaatgtaacattttaaaatattagtattgtctaaagatgtttttcctgttatttctaactaccatccacctaatcatcaaatatagaaacttcggtgttcttagacacattaatttcctttatctacctgtaaactggttactaactcctgttgagttcacctgaaaatctctccaaaataatacttctccatttttattgataattaaatgaatgaatgatgttaaaattaattagtattaatttagaaattagaaaagtgaaaaggtgtatcgcaaaatgtcaaaagttatgttgacatttttcaaagcgaagcaataattactgttaaaaatgctcaaaggccctgtacatctgttcaaaagtaacttagatgttcagctaaatgttaagactatattgagtcaactccaattacggttaaaagatggcaaagcaacacttatcttcagctaagttttggataatgttgacaccatgcttgacttagtattaagcatcttgtattgccaaagctgttaatcctaaatatactgtgatagctagaacaaacaatacatagtaacttgaaaagatcagagtactccaacactgtgcctgctagacatgtctcagtttatctggtttatgattacaagtttaagcagagaatgtacaaaacttgtacataattaaatgaatgaatgatgttaaaattaataccagttaattttaatactagtcaaaattaatactagttaatactagttaattttaacatcatccattcatttaattatcaaccaatgcatatatctcagaagctgcagggtagctgacagaaatgtcacattggagatagccttttaaatatacagaagctcaaagtgaaattggttatgtccgcttctccattttggatcaacaatgtaaaaataataaacagttgcaatagtccattccacttagcaagtttttgacatttggaaaatatcactgatggttcagtacaaaatacatatgttacctttgacttcaaaagaggaatttatcatagaaaaataagaaacaatttctactgctgattttataaagttcacttcagcttattattcagaacaagtcagatcacaaatatgatcaaacaaaatacttcaaacccaccaggatagggcagggcaactccaatgtaaccacatagaatagggaaagtagccaagttaaaaaaatatgattccaacaatataacattttattagttcttttttattactctagctaatacaccattaaggtgaagtgattcactgtctattctatataaagctgtttataggccaggcatggtggctcacacctgtaattccagtactttgggaggtcaaggccagcggattgcctgagctcaggagtttgagaccagcctgggcaacatagtgaaaccccatctctactaaaatacaaaaaaattagccgggtatggtggtgcactcctgtagtcctagctactcgggaggctgaggcacaagaattgcttgaacccgggaagcagaggttggagtgaaccaagatcacgccactgcactccagcctgggtgacagagtgagactctgtctccaaaaaataaaattaagtaagtaaagtagtttataacaacaccatgattgtctctgttaattttcttttactttctttttttttttttttttgagacgtagtttcgctctgtttcccaggctggagtgcagtggtgcgatctcggctcactgcaatctctgcctcccaggttcaagtcattctcctgcctcagccttccgagtagctgggactacaggcgtgcgccaccactcctggctaattttttttgtatttttagtagacatggggtttcatcatgttggccaggctggtctcaaactcctggcctcaagtgatccacctgcgttggcctcccaaagtgctgggattacaggcatgagccactgtgcctggccgtctatgttaattttctaaaggggaaccaaattactctgaatggttatggtggttatttggctatagtaaaaacacttcctatgaaaacaagattctcttttcactttatcccagaatttacatacgatcctccaaaagtaacatattttatcagtatactttaaaaatacgtgtaagtgcatatccttaaacttgagtatgttagtcttcctttttgtaaattcttttatttcatttcctaatgtcatttcctttatgtcatttcccttatgtaaatgcaatcttgatttagcttcatgatctttattttaggctggctcagttgcacagagcttccttttctcatttataaactgaggagcttccattgtaggatgtttagcagcatccctagcttctacccactagatgccactgacatctcattcttttcccccaattgtctcctagggtggtagggggacaaatggctcctggttgagattcattggtttgaaaggagaatttagtaatattaaataagattaactagatagtaatgtaattagaatggaatgagtgagcaccacaagtcatagggcgtgactgcaaataagaacataaactcttcaagttgtcatgcgggtgacagctgggctactcttgatctaggtggaggatacacacacacacacacacacacacacacacacacacacacacacacacaccatattccttaccaagacctcctaaccctctttttctgaaaggcactataatttatagaaaaacacaatcatataggaattgggaatctgggctctggttttgtctttgtaacttaatttgctatatggtcttaagtgaactgctgcacatttggacctcagatatctaaattgtaatataataggtctagtgaagataatctccaaggttcactttagaattatgattttcaagacttttatcaattttcttcctgatgtgtgtttttttaatttttaaattttctttaaagacgggagtcttgctatgctacccaagctggctttgaactcctgggctcaagcaattcttctgctttaggatccctgagtagctggtaccacaggcatgtgcttctgcatgacctacctcatgttttttatctggataaagaaggtgtacacaagcatacagattgggaatttaaaatttaaagtctgtacaaatgtaatggtaagtgttcttgaatttaaaaagtttgatacttttaaatgaatgatttatactatttatgaattttaaaaagaaatacatacatatatatgctttaaatgcttactgtgttaatatttaggacctatttcccatatcctagtttttccttctaatgcagaaaccatccttctcactttcaaattggaggcaaataagacaactgctaatcaagaactgtgaagacatattaacttagagataatattagagaaaatgtcaatgggatgtttcaatattttatgatttcattaaatagtatattataaatatgaagcagctaatctgaaaattcatgctgagattgttctctgtttttttttattatttctatagctgtaagttatatgattcaagttgttacattttgtcaaaattattttcaggtcaggtatagtgactcatgcctgtaattctggggctttgggaggcagaggccagaagaatcacgtggggccagggttcgaggccagcctgggcaacactgggagacactgtctctaccgaaaaaaaaaaaatcattaaataaataaataaataaataaataaataaattagccaagtgcaatgacacgcacctgtagtcctagctatttgagaggctgaggtgggaggattgcctgagcccaggagttcgaggctccagtgagctatggctgcaccactgcatgccagcctgggtgacagagcaagactctgtcaagaaagaaaaaaaatcctttgccgatatctgacactaggatatcatttctgctataagttaaaattttacttagaattttacttaagttaaatttttactaattgtatcccattatttccagcagtcgtctttgcattacttactctgaaatttactcagttgtgttttaagtgtttcaggtctcatagaaagtaggaaattttgtaaactttcaggatttatttggcagtaacacaacagttttgaagtagaggaagagtagagaattctacatgttatctgctaggtttccttaggatgccataaaactctggctctgtttagaatatatatatatgaataggactgggtgcggtggcttatgcctctaatcccagcactttgggaggctgaggtgggcagatcatctgaggccaggagttcaagactggcctgggcaacatggtgaaatcccgtttctacaaaaaaataggaaaaaaattagctgggtgtggtgctggatgcctgtaatcccagctactcaggaggctgaagcacgggaatcacttgaaccagaaggtggaggttgcagtgagctgagatcttgccactgcactccagcctatgcaacagaacaagactctgtctcaaaaaaaaaaaaaaaaaaaaaagaaagaaagaaagaaaaagaaaaagaaaatatatatgaatctagggactcattttaaaaacagtccataggcaggcagaccgggagcaagtatagaacagaaagaaaaataactctttcataaatggccatacagaatcagctctctcagtggtggaaaggacctacttgggatcaatactagagtttacaatgttaaattacagaagacatgaagttttctaatcaagaaacccaaattataataaaggagttacttttcatgtattgtataatgagctataaacttatttgcatttttttaaagtcactgaatcatgctttggtcatttttttggttatatttaggtataaaacttggtaaggagagcacagtttaataaattcatagtttaataaattttcctccatggaaaattttaaaataagattgaggcccagcgtgatggctcacgcctgtaatcccagaactttgggaggctgaggcgggcagatcacgaggtcaggagatcaaaccatcctggctaacacagtgaaacctcgtttctactaaaaatacaaaaaattagccgggtgtggtgatgggcgcctgtagtcccagctactcaggaggccgaggcaggagaatcgcttgaacctgggaggtggagcttgcagtgagccaagactgcgccactgcactccagcctgggtgacagagtgagactccgtctcaataataataataataataataataataataagattgacaaaccaatttgatagattgttgtgattctgatctttgtgcaaagacttaagtctcttacttgtctcaatacaataggtcttagctaataaaatccattccaaaaatgcaccatttactagcattttctgagaatgacctccgcgaatgtattacattctgaaagacagtaaccaattaggcgtctttagccagtcaattatttaaactgcctccttaaagaaaacaaactggtagaatgtactgaaaaattcccaatgaaaagtgtaagaaatgttaccaagcttttccataaaacaaaggagaaaaggtttaacggcacattttatggattatgataattgcagaatgatctccaggaattaaaagattaactttataaagctccttaaattataatggaatcaaaggaaaagaagtgattaaaaaggtatttagtatcagttatcagttactcaacaataaaacagaataaactcataattgtaatgtgccagttaatcctttttttttttaaacagcatatttagttgcctactctaaatgccactgtgcctatttcccatctcccttgggtactggaagtttgcaccttatttatgaagagaagcatgataacccacagactaaaaactctaaaaagcatgttaattcaggaaatgctactttaccaggctagaactggaaatagtgtttcactttttaattttagggcatattattcatttatcaactattacctattacatggcaagttctgttctagacactgataacctgtgtaccacacaaagttccctactctcatgaagtttacattctagtggaggggacaggaaataattgcaatgagtgctattatgaagaaaacaaaacaagatacagtgaaagagaatgaccggaaatgatgagacagaatggtctgagaagacttctttaagatggtatttgagcagagacctgaatattgagataaaattagtcatttgaagagtatatgaaagaatttcctaggttaaaaaaaggcatattcctaagaatagaaaggaggttagtgtaggtggcaggtggaaaatggtacatcaggacactggagaggcaaacaggggccagttcatgtagggccttgtaaatcaaggcaaggaagcttagattttattctaagtgcaagaagaagtcatagggaggtgtttaaagaggagaatgatataatttgatttattctttaataatatcactctatttgctatgtagagaatagatcgtagtgggggaaaagtggaagaaacgacaagaaaccgggagtccaggagggatatcatgatcacctgcacaaggatgccagtgaggaagaatgagagatggattgagaataggatttacagctgatgggaattaatctctaaagaactctttatgttctatggctttgttagttcttttgtgcggggggagggcttatttctttttcttttatgtagaatcacacatattcagatctggaaagaactttatgggtatctcttctaattccctactcagtgcaggaataccagtccagtaacttggggagatggtcagtaggctttggtgaaaggtagttattaccttgcaaaatgatctttttgtgtagttttcattattatattagacagctcattattacatggagctgaaattagcctcagtatcctattaactttgtcactaagtttttattgtgttaattatgtatccggtgctataatagactgggtactaggtggtaacaacgatggtaggtaggtactaggtggtatctaatatatttcatgccttcatggagctcactttctctcagggagctgagcacagaattcaataaattcaaacaattcaataaataagtcttttaaattttatcctctagagttactcatattgtatctatcctctcttatataagataacctttcaaatatttgaagacaactattatgttccaacacctcaattttgtctaattcatttaccaataattcattaaatatttattgaatgccaactataagagaggcactgccaggtgtgagggacacagcattaaaacaaaaatcaacagttaaaatgtttgtgtcttcaaggctacattctagtgaggaaaaatataataacaacaaaaaacaaataaatatgtactatgtcagttggtagaggcacaggtagaaggaatataaggcgtctcaggaaggtgggggcactgctattcacacaggctagtcaggataagaggacatttaagtacaaaactgaagaacacgtgccaggcattgtactaggtcctgagggctaggtattatgtccagggtgggagtagggtggggtcaaaacattagcatgcctgccccgagaaatgttcattaaatcaaaatgtcaagatcagcaggagctctctaccatacataaagggtatggtagagaaataacaggtacaaaagccaggaagtgcgacgagagaagaaagaacaaggagagagatgtaatcaggctgcagaatctggtagaggctaaccatcccagatatttcaactggtcctaccaggacataggttcccccagatccttccccttctctgaatgtgctttaatgttgtccatgttttctttggggatagcatgactggtaccactacctgctttatactgcatgccatatttctatcactacaacctaagatggcagtcctaatctattgcatttgtaatccatcacagagccactcaatttttttttcatgtgaaatgcttgtgacattgccataggtacttcaggcttcctaatcctgatggaaactatgtcccagccacagtacttggagaggatactggggaggcatgcagagccacactgatatggaacatgggctaattccaagtctctctgcttttcccttccctctttcactcttccttggaaatatagcttcactgtgtacatatgctcttgcttcctgttacaataaatctgctgagaaaaggtgaggatcacatttctacaaattgaacacatcgatttaaatatccttttgtgattcttaggctatctgaaataacataatttctcctttttagctagttaatataactgcaacttaattattctgagtctcaagcataccctaagatgagaaaaaaaaaaatctcagctgtgactatgtaatctcattaccttctaatcaagactttactgctatatttaagtttattctcatgggccttatgtacttggtttcaatctccctcattttattccatgtctgtcctctgtttatggtgctgctttaataagtttggcatggatcacatgctaagtgagtagatgttagcttctcttgcaataaaaaaaaaacaaaaggatgggtaatcatgtgagatgaatatgttaatttgcttaaaaaattacttataatcaaattacttgcttataaataacctttttactatctatatgtatcctataacatcatgttaaatctatacaataaaaaacttattaaaaaataagcttagcatgatctctgctgaagaagtggcccctttacaacacatcttctttagcatggaagaattggcatcctagaaatgagggaagtagggccagtataagctactttggtcacaaaagtgctgtgtaccttttgcccatcctctcatcattgtctctaactggctgatatgcaactaatgatttgcctctgcattgcagatctctttggtgctgactggacatagtgggtatatgcctaaagcgaattggcagtccctttgttctgccactggtgaagaaaacccatatcccatctcctgatgcctggcaaggcaaataatccatttcacacagtgatccgggaagaagtgattggcgggttcttaaacatctttagggtttatcagatttcactgcaatctaccacatagggtttttaaattattattattatactttaagttctgggttacatgtgcagaacgtgcaggtttgttgcataggtatattcgtgccatggtggtttgctgcacctatcaacccatcacctacattaggtatttctcctaatgttatccctcacctagcctccgacccccgacaggccccggtgtgtgatgttcctctccctgtgtccatgtgttctcatttttcaactcccaattatgagtgagaacatgtggtgtttggttttctgatcttgtgatagtttgctgagaatgatggtttccagcttcatccaggtccctgcaaagaacatgaattcatccttttttatggctgcatagtattcgatggtgtatatgtgccacattttcttaatccagtctactactgatggacatttgggttggttcccagtatttgctattgtgaatagtgctgcaataaacatacgtgtgcatgtgtctttattgtagaatgatttataatcctttgggtatatgcccagtaatgggattgctgggtcaaatggtatttctagttctagatccttgaggaatcgccacactgtcttccacaatggttgaactaatttacactccctccaacagtgtaaaagcgttcctatttctccacaacctctccagcatctgttgttgcctgacttttttatttatttatttatttatttatttatttttattatactttaagttttagggtacatgtgcacattgtgcaggttagttacatatgtatacatgtgccatgctggtgcgctgcacccactaactcgtcatctagcattaggtatatctcccaatgctatccctcccccgtacccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcttgctgctataaagacacatgcacacgtatgtttattgcggcgttattcacaatagcctgactttttaatgatcgccattctaactggtgtgagatggtgtctcattgtggttttgatttgcatttctctaatgaccagtgatgatgagcattttttcacatgtctgttggctgcataaatgtcttcttttgagaagggtctgttcatatcctttgcccattttttgatggggttgtttgttttttcttataaatttgtttaagttctttgtagattctggatattagccctttgtcagatggatagactgcaaaaattttctaccattctgtaggttgcctattcactctgatgatagtttcttttgctgtgcagaagctctttagtttaattagatcccatttgtcaattttggcttttgttgtcattgcttttggtgtttcagagatgaagtctttgcccatgcctatgtcctgaatggtattgcccaggttttcttctaggatttttatggtcctaggtcttacatttaagtctttgatccatcttgagtggatttttgtataaggtgtaaggaaggggtccagtttcagttttctgcatatggcaagccagttttcccagcaccatttattaaatagggaatcttttctacattgcttgtgtgtgtcaggtttgtcaaacatcagatggtggtagatgtgtggtgttatttctgaggcctccgttctgttccattggtctatatatctgttttggtaacagtaccatgctgttttggttactaccgtcttgcagtaaagtttgaagtcaggtagtgtgatgactccagctttattcttcttgcccaggattgtcttggctatgtgggctcttttttggtttcatatgaagtttgaagtagttttttccaattctgtgaagtaagtcattggtagcttgatggggatagcattgaatctataaattactttaggcagtatggccattttgacgatattgattcttcctattcatgagcatggaatgtttttccatttgtttgtgtcctatcttatttccttgagtagtggtttgtagttctccttgaagaggtccttcacatcccttgtaagttggattcctaggtattttattctcttagtagctattgtgaatgggagttcactcatgatttggctctctatttgtctgttattggtgtataggaatgcttgtgatttttgcacaatgattttgtatcctgagactttgctgaagttgcttatcagcttaaggagatttggggctgagatgatggggttttctaaatatataatcatgtcatctgctaatggagacaatttgacttcctctcttcctatttgaataccctttatttctttctcttgcctgatttccctggccagaacttccaacaccatgttgactaggagtggtgagagagggtatccttgtcttgtggcagttttcaaagggaatgcttccagtttttgcctattcagtatgatattggctgtgggtttgtcataaatagctcttattatgttgagatatgttccactgatatctggtttactgagagttttggcatgaaaggctgttgaattttgtcgaaggcattttctgcatctattgagataatcatgtggttttcgtctttgtttctgtttatgtgacggattatgcttattaatttgcgtatgttgaacgagccttgcatcccaggaatgaaggcgacttgatcgtggtgggtaagctttttgatgtactgctggatttggtttgccagtattttattgaggatttttgcattgatgttcatcagggatattggcctaaaattctctttttttgttgtgtctctgccgggctttagtatcaggatgatgctggcctcataaaatgagttagggaggatttcttcgttttctattgatcggaatagtttcagaagaaatggtaccagctcctccttgtacctctagtagaattcggctgtgaatatgtttggtcctggactttgttttggttggtaagctattaattattgcctcaatttcagagcttgttattggtctattcagagattcaacttcttcctggtttagtcttgagagggtgtatgtgtccaggaatttatccatttcttttagattttctagtttatttgcatagaggtgcttatagtattctctgttagtggtttgtatttctgtgggattggtggtgatattccctttatcattttttattgcatctgtttgattcttctctcttttcttctttattagtcttgctagcggtctatcaattttgttgatcgcttcaaaataccagctcctggattcattgatttcttgaagggttttttggtgtctatctctttcagttctgctctgatcttagttacttcttgccttctgctagcttttgaatttgtttgctcttgcttctctagttcttttaattgtgatgttagggtgtcaatcttagatctttcctgctttctctcgtgggcatttagtgctataaatttccctctatacactgctttaaatgtatcccagagattctggtacattgtgtctttgttctcattggtttcaaagaacatctttatttctgcctttatttcgttaggtacccagtagtcattcagaagcaggttgttcagtttccatgtcgttgtgcagttttgagtgagattcttaaacctgagttctattttgattgcagtgttgtctgagagacagtttgttgtgatttctgttcttttacatttgctgaggagtgtttcacttccaattatgtggtcaattttagaataagtgggatgtggtgctgagaagaatgtatattctgttgatttggggtggagagttctgcagatgtctattaggtccgcttggtccagagctgagttcaagtcctggatatctttgttaattttctgtctcattgatctgtctaatattgacagtggggtgttaaagtctcccattattattgtgtgagtctaagtctcttttactgcatcggttaattctacttcctgacaactgcaattttatttttattctacaagtatcagagacataataatggataactctaacagggtccttgctttcatggagcttatagcctagtgtcagggttactataatcacaaatttagttaaacttacagtttcacctctaaagcccttttcacctctgggtccctaaaagaaaaaaaaaagatgttagttcattgttattgatagttacgtattaaatgtagctgaggtcattatatgtagaaacatgacaatttatatttttgctttttctatatagtaagacctgttttgttaaattgtataagttctagtgttcttttcctaaataaagcaaagcaaacaaaaaacccttagtgattcatgttgtctgctttgctgttcctagttctaaccttaaggtgagactgagataactacttattcattcaattaagtcaaaacagcttatctgacaatcatatacaaagcaatttaaaaaggaaattctaaattcaggttaaattcttctaataattgtttttcttaacttttgaaaaccctgtttctgggatggtttcccttctctttcttgcaaattttaatatgttgtatatgtttccgtgcagttcaaaatattttctaattttcttggagacttgctctttgatccatggattatttagaagtgtgtgatttaattttcaagtgtttggagattttcctattatctttctgttattgatttctagtttaattccattggcaagagaatataccttctatgacctcagttcttttacatttagtaaaatttgttttatggcccataacatcttctattttggtgaacgttccatatgcacttgaaacgaatgtagtttgccattgctgggtggacctactgcttttaaaatgtgttaatattttcctgttcatccttttgaaaattttatatgtatatatatgtaaaaaatgagatactattcatcttttctgtaacctgaatttacaccttcataaatataatatgaatgctcttccatgtcaatatacattcttttagataattaaaatatttaataatcttacctagtatttaatatactatgataatattttaaatttgctattattagactttttgctaatttttgtcattgttagcagtgttgtgagagatacccttacagtctaaaatttttgttaaagactgtcttccagaaagttagtttgaaattacatacacacctgcaaaaatggaagtgtacatttcttctgatctatgtcatgttctttgttaatttgcaagctaagaatactatcttatcatttattcaccatttatattacttctgtgtttctcatcttgtctcaattcattttaaaccagggtattaacttaaaaaaaacttatttatttatttacttatttttttttttttgagaaggagtctcgctctgtcaccaggctggagtgcagtggcatgatctcagctcactacaacctccacctcctgggttcaagcgattctcctgccccagcctcctgagtagctgggactacaggagcataccactaagcccagataatttttgtattttcagtagagatggcgtttcaccatgttggccaggatgatctcaatctcctgacctcgtgatccgcccgcctcagcctcccaaagtgctgagattacaggagtgagtcactgcgcctggaccctgatttttaagatatctacacagcactttaaaaaaatatatacacccttttccacaccctacccagtattaacaacctggtatgtatgttttcatacctttttctaatcaaatattgacaaatacatttatgtatgtatgagaaatattgctgttttaaaatattggaatcatattatatactcttctatgcatcgcacttaacaatacatcatgaaataactgagtcagccaaactagatataataaattcttttaaacaattgcataatattccatgaaatggctaacctataacttactcaatcattcctttagaaatgagtattcacgtaatttcaattttttttccaataaaagtagtattacaaaaaaaagtctttgcaaaatttcattagtgtattgggtgcttttatacctatgggataaattcctccaagtggaactgttttgttaaagaatatgtacctatatttaacaaatctttccataaagtctgtaattcacatttttaccagtgatcaatgagagtactgttttctcctatattcccttctgagaagttaaatgtaatatcttattttactttaatttgcatttctctgacttaaatttaggtgagtgtctttttattataaaacaatagttgaacttttggatttgttctttttttctccgctggctacttttttgatggaatgcttttcatttttctattgaactttctttttcaaactataagagctcttggtatatgtgtgtatatgtctctatctctatctatctatctatctatctatctatctatctatctatctatcatctatctctagatacatacacgtatccatagcaacagataggtagataattttttatttttaaattttttttgcccaggctggagtgcagtggcatgatcatggctccctatagcctcaacttcctcagatcaagtggtcttcccacctcagcctcttgagtagctgggactacaggcatctgccactacgccaggctcattttaaatttttttgtagagatgggatctcactatattgccaaggctggtctaaacttctgtgctcaagcaatcttccagcctcagcctcccaaagtgctggtaatacagccgtgaactactgttcccaactgagctctttgtatattaacctgttatatattgtatgctttgtaaatatttttcccaatcaatagtacttttaaactttattcatggaatcttttttccatacaaaatgaaaaaaaaatttcaagtattcaaatatactttctgttcttttacaggtctccccaatccttaagctacatgttagttttctagattattcttcaattttttttttttttttgagatggagtttcactcttattgcccaggctggagtgcaatggcatgatcttggctcactgcaacctctgcctcccaggttcaagagattctcctgcctcagcctcccaggtagctgggattactggcatgtaccgccacacccggctaattttgtatttttagtagagatgaagtttcaccatgttggccaggctggtcttgaactcctgacctcaggtgatctgcccacctcggcctcccaaagtgctgggattacaagcatgagccactgcgcttggcctcttctaagatttttattgttttattttttacattaaagtcgttaaaagttcatctaggagtaaaatacttttggcaaatggggttccaatttttctttcttcttttttccttttttaaagagatggggtctcactctgtttgcgcaggctggagtgcagtgggtgcagtcaactcactgtagcctggaactcctgggctcaagcaatcctcccatcttagcctcccaagtagctagggcttataggcatgtaccaccacacacagctaatttatttttatatgatgggggtctcactatgttgcccaggctgtgttccaatttcttatagcaggaggatactcaaagtaattccatctctcttccctgtcactgacgtaggagtgaacatctggctgaatgctagacaattagatatgaaaaaaatgtaatcggagacttctaaaaaattcttatttttgccacaatagtactttatgtcattttttttttcctttggataattatatctggatgtagttcttgagaagttgtagtcatcttgctataagcctaattatgaagccaacattcaggatattagagtagagacatagagatataagagatacataagaacctggtcttggatgagataattgagtcgccaaattaaccaaatctgaaggctttcctataatgtgatacaaattttcttattgctaaaagtactttggttcagggttcctattatttgcagccaaaccttcctcaattatatgccatttttgttgtaagtaaattcctatatatacttaagatcaaattctgggctctagtctgttacaccgatctgtttatttctttgtattaccatatagtttcatttacaaatttccaagcctgtcacccctcactggtattttttttcccaatgctttcaccaatctgaaatgcttattctttcataatgaacttttcttctcagaatggaaaaaattgaatatggaaaaattgatgtacatgctgaatattataagggtctttaagaactatctataaacaaaacacagtaagatattttaattaagtaattttaaaattacattttccttgaccaattaatacatcatatttttgacagaggagaaaaatcattctgtaatcagaacagtatgtgtcccttagcttgctgaagaaccactcactgaaatatgagaattctcccacttacaatcttatatagctccgagtggcaaatgttgaaagtctacagaaatactgagttatacattttacttcttttgtttacatatccagtaactttggtggtttcttctctaaatttatcaaagagaatagtggtactaaacacttgaagcattctatttttatattttttaattgtctgtgtctataaataactttcaaataattcaaaatattaattccctagatagaatgaatctttcctctctaagtctcaatttgaccctttctactgtgctccttgcttgtttatactattatcaatattggaaaactttcccaacatcacttgaccaatcattgtctcatttttatgttttatttcatagccaaatttcttaaagcactggcatataatacctcaatttcctctccagacacagcttgaatggagtggaaagagcgctggtcttgaagaaacaccagctatgtaatccacgaggtctatcaccttgaatgactagatgaacctccataaacctcatctgtctcctcatctgttaaatgaaaataatatctactgcaaaagtttgttgtaagaatttaaggaacattattattaaacattttcccctacttccttcatcactgtaacctgtactgtatcttctactgcaatttattctctcaaagattactgttgactactcctttcttgaaacacttgctattctctcgaacgattctttccttcctttatagtgggtacttccaaaaactcaaatgttggatgtctgcacatcttttgctatctatgttctttccttcagaagaagaatttatttttattgctcaggagttcatctctatgtttataacactctccccttcctgactcagttctattttcttttctcaactccaattataaacacttacctacttagttacactgtcttcattacacatatggtccctaacttctcaggaatcattttccagaagaaaatgtatatctattttttccattttcttctcaaatacccaggctaattctttgtagaatattctagaaatagaattaaagaaaaaaaagagtacaaaagacttgtattatgataaacttacagttctacctgttgggcctattataccttctctgccaaggggaccagtgtttccctgttgaggtaaaagaaaaacagtctcactgttagtataattaaaaaaaaaaaaactccacagaatctcttgtacaatggtaaaagagccatgtctacataattatcctttttagtataaaagcttacagtattagcataaattacaataatcttggttaacagtatgtgacacaattctgcatattattaaagtctcttatcaggagagttgcatctgtataatttctaaaaaactgatgaattagcattatgatttttatgtggtgataacttcaaagatgcattttacatgtatgttatataacaaataaaactactttatataaaaaagaatagaatgatgaactaggttttgaataaatttctgtgcagatgttgaaaaagtagatgtttgggtaacatgaagcatgaaatagagaaaaagtacagtaaggaaccagagaacagcatatgtgaccaactaaacttcagttcttcatctgtaaaacaggaataagaacatctacttcatagggccattgtgagaattaaatatgaaaagtgcttttaaaactttaagctattatttggttatgaagataaccttgaataagctggatttctggtcaattcctcccaaagtaggaagagagtctataatttctcagtgaatacaaaatgcccattttagttttttcctacaaacttcagcttccgtggttcttcagaaatcatgaaaataactaatatatttatagctgaagaaatattcagaaaggtctttaaacaattaccatgataatactcctctttgcattattttttgaattagtattgttttaactgagatggagtcttgcttcttgctgtcgcccaggctggagtgcagttgtgccatctcggctcactgtaacctttgcctcctgggttcaagtgagtctcctgcttcagccttccaagtagctgggattacaggcatgtgccaccatgcccagctaaatttaaatatttttattagagatggggttttaccatattgatcaggctagtctcaaactcctgacctcaagcaatccacccgccttggcctcccaaagtgctgggattacaggtgtgagccactgcatctggccctttttgcattttttaaaattatactttaagttttagggtacatgtgcacaacgtgcaggttagttacataagtatgatagactggatgaagaaaatgtggcacatatacaccatggaatactatgcaataaaagatgatgagtttatgtcctttgtagggacatggatgaagctggaaaccatcattctcagcaaactattgcaaggacaaaaaacctttttgcattattgacaacaatttattgtaagagttaggaaagcggtataggattttagaagtttgactttcatttaatagttatttaagatacctttatcctacatctgcactgcttccctttttcctctctctgctctttcaacacttgcccctgcagctgctattagtcatagagatgctactaccacagccaaaccattacttgaagttttaaattttttttcagctttttttcagttttatagaacatctcatcaattagaaagctttgattaataaaaactaaaaacaaaacaaaaaactaaaaacaataatcagtaagcactggtggcttatttgtcctatttatattctctacaatttgcaattacaagcactcattgctaattggagttcttcagaccctgctttttgcaactatttaagcggttcctcatcactctcttgggatacctgcccctgagctgggaaaacacagctattgggaaatattttcagtctggtctgaagagctctggtcatacacaagcttcttccaggtggtgcatggaggtggtctctggttgcattaatgcttataacgtgaaattgctgtatgtttttgttcctggcgtgagttaatacattatccagtcttcacagtaattctgatgattctttttttttttttaagtaagactaggaagtacgggtggtctatgaggtattttgctcaaactaatatatgaactgcaaaagattgaattctgcatgtgcccttatgagtttctaccttaaaagtcatttcattaagttatttacttgaagtacattacatttagagctcttaagccctgcagtaagcaaagaaccacaatttctggtaggcagaatgactttacacttactctgtgtccaataggacctttaggacctgatatcccaacaatgccagcatccccttcaggaccctagacatacaataagaaacaaaaagataaaatttgtagctctatatgaacattttacaaaactatataaatctatcaagaattgctcttttaaaaatggaatataatactgttgtgcatgctgaagaattcagaaggaagtgtactgaggcctacaatttacttagaaatacaccaatgaagggagagagggatacgtagatggataagcacaataatgccagcagggtaaaatgttaatggtaaaatttaggtaatgggtataggcatttactgtaaaattttctcaacattgctgtatgtttgaaaattttcataataaactgcttgggaaaagggatgaaagaaaacaaaatcatatcatatactaaaatttctgggaaaatgtatagttacataattttaaaaacagatgtattcgaaactcaaatatataaatatgtaccaactgaaattttacagatttaaaaaagctcaagttacagactatattatttcaacagctcttttatttctagatagctagaagactagaagaaagtatgtaaacatactttagggcctgggaatccttggaaacctgtcaaaccttgaacaccatattctccctgcaaagtgaattgacatgataataattattgtacaatggcagcctgctctgtagaataaatgcttggtgaatttctgaggtggtacatacaggctgccctttcaggccagggtctccacatggtccttgatcaccttgtgctcctcggtgacctcttttaccttgaattccaggttgaccaggtagcccttgttcaccctatgggtagaacaaagaaaagcgatctttacatcagaacatataaacatattggcttttgaatgaaacccaaatacaggcccatccttaggcccattccataaatacaaggcactggggaaatcaaattttgcatgttcatcttgttcaccaatattttccacacaagtagtatttaattataatgtaccagaagagtagcagtgggaaaaggaaattccagagattgtggtgatgtgtggaaagaagagggaagggggaacctataaaactagtaggatagtaaggcttgagaggggatagtgagggtgtggtatgtgtgggtgtgtttatatgtgatggaacttatattttgtttatttatttattttattttttattagagatggggtcttgctctgttgcccaggctgtagtgcagtgatgtgatcatggcttactgcagccttaaactcctgggctcaagcgatcctcccaactcagtctcctgagtagctgggactacaggcacacatcattgcacctagctaattctctatttttttgtagagacaggatctcactatgttgcccaggctggtcttgaactactagcctcaagtgatcctcctgcattagcctcccaaagtggtagaattacaagtgtgagccactgtgcctggccagaacttgtattttgaattgatatcatttttctgtgttttccctaccatccagagatgattcagctatctaataccagaaaaagagtagtctcctgaagtgtaaaccctggttttagccatgattatctttttaattccatcaataaaaaatttccattatctgtctccctagattcctttgatatgaactgtctttatcccctaaaagtcactttaagtacatacttaatcaacattattgaatttctaaaagtcaagtcttttttcattgatttttatttttgaaatgagagttgaaatatctttcacaccatttctaaaagtaaatttaggaatcaggtggattttagagataggttaatgaaaaacgatgcttggtagactttggccaaagcttctttaagattaacaaattatctctcactgtcttgagacaaagctatacaattttggggtttgacaaatatggatctttcttattgcaaattcaagcctaaaacatgggatctttacttcttttcctggctttagcatttgcttagctgctttgaattttagcacaaaggaatattcatggtataaacattaacagaagactaatattgtaaacagtaaacaagtaggtcatgattttcagtttacccacatgggtcagaaatctgaaaattctttagaagtggaactgggaaaatcaggttaagaggtaataatggtaagggtgccaatgtcttagtcttaggcttttatgaaagagctttagatgttggactaatttctaagttgtctgggtcaatcctgtatgagatatttctaaaagaggttttgtctggaaagtctattgacatgtgacagactccacacaataaatgcaatataagacttagttactgtcacattaactctaagaaacagtctgtacggttatcagattaattaattggttggttaggttcagagtcagaagaaaaggaattgtatttgagaaagtatttatctggaagtaaataagatttccctgttttggaggagaagacagatgacagagaaggaaaaagaacaaaaatgagtcaaagacatagcattttttaaagcatcactagtcctgggtcaaagagttgttatgacaaattacaggcactgtggctatcatgggagatggatatgtcaaaactacatactttctcttttcctaacgtgcttttactattagccaaattctattaaaaactattaatcttaccattctgtgatctagccaatgaactcagggccagaaaggatggccaatactgcttacccattggaacaaaatattaaagtacctttgggccttgaattcctgggcttcctggcaagcctgatgaaccctttactcctggaggacctggagccccagcaagacctgttcttcctgggccgcctctgatgccctaaataacacagataagaaatgaaaactgggaaagtttctaaaaagtcagtttagaggctcaataaaatgtaggaagagttgtgccccgaaaggcgtctgttaacatactgcccaggagttatcctgggcttctttcccagaagatgaaatgtttaaatacttttttaggaatactcaccactcacttgaaatttctataatttatgcaatgatcttgggtttttaaaatgaaaacactaaagcaatacgaagtccaccagtaccttcttacttataaagcctaggtgtgaagtatgtttgttgtgttctaacttttgtattatactctggtgtacatggcaactctaataactgctgaaagtctccttaagaagaaaattctattcctcaaccatacatgattccagaaaatttgctaaaaattgtttaactggaaataaagttaagcaagcaaacagtatatccttaaaactaaatcctaaatcaggttggcaaactacactttgcaaactaaattcagtccatcacctgtttttgtagatctcatgaactaagaacagtttttacatttttaaacattgaaaagaataatacttaaagacatggaaaaattctatgaaattaaaatttcagtatgtattaagttttactggacagtcatgctcattcatttacatattgtttagggctgcatttgcacaacaatagcagagctgagtagttatggcagagtttttttttttttaatttcattttaagtttccgggtacatgcgcaggatgtgcaggtttgttatgtaggtaaatgtgtgccatggtgatttgctccagctatcaacccatcacctaggtattaagtccagcatgcattagctatttttcctaatgctctccctctgcctctgtcccacctccaccaacaggccccagtgggtgttgttcccctccctgtgtccatgtgttcacattgttcagctcccacttataagaccatgatatgtttgattttctgtttctgcattagtttgctgaagataatggcttccagctccatctatatccctgcaaaggacatgatctcattcctttttatggctgcatagtattccatgctgtatatgtaccacattttctttatccagtctatcattgatgggcatttgggttgattccatgcctttgctattgtgaatggtgctgcaatgaacatacgcgtgcatgtatctttatgatagaatgatatatattgctttgggtatatacccagtaatgggattactgggtaaaatggtatttctggtattcctggactttggttccttaaggtcttcgaggaatcaccacactgtcttccacaatggttggactaatttacattcccatcaacagtgtaaaagtgttcctatttctctgcagccctgcaagtatctgttgtttcttgactttttaataattgccattctgaccggtgtgagatggtatctcatcgtggatttgatttgcatttctctaataatcaatgatgctgagcttttttttgatatgtttgttggctgcatgaatgtcttcttttgagaaatgtctgttcatgtcctttgcccactttttatttttttaattttaattttattttattatgttttttggagacagagtcacgctcagtcacccaggctggagtgcagtggtgcgatctcggctcactgcaagctccacctcctgggttcatgccattctcctgcctcagcctcctgagtagctgggactacaggcacctgccactacatccagctaatttttttgtatttttaacagagatgtagtttcaccgtgttagccagaatggtcttgatctcctgacctcgtgatccgcccatctcggcctcccaaagtgctgggattataggcgtgagccaccgcgcctggccctttgcccactttttaatgaggttgtttttttcttgtaaatttgcttaagctccttgtagattctggatattacacatttgtcagatggttagattgcaaaaattttctcccattctgtgggttgtctgtttgctctgatgatagtttcttctgctgtgcagaagctctttagtttaattagatcccatttgtcaatttttgcttttgttgcaattgcttttgatgtttcatcatgaagtctttgcccagcctaagtcctgaatagtattgcctagattttcttctagggtttttatagttttgtgttttacatttgtctttaatccatcatgagttaatctttgtataaggtgtaaggaaggagtccagtttcaattttctgcatatggctagccagttcccccagcaccatttattaaagagggaatcctttccacattgcttgtttttgtcaggtttttcaaagatcagatggttgtaggtgtgtggtcttatttctgagttctctattctggtccgttggtctatgtgtctgtttttgtatcagtaccatgctgctttggttactgtagctttgtagtatagtttgaagtcaggcagagtgatgcttctagctttgttctttttgcttcagatagtcttggctatacgggctctttttttgcttcatatgaattttaaaaaatagttgtttctaattctgtgaagaatgtcaatggtagttttatgggaatagtattgaatctataaattactttgggcagtatggtcattttcacaatattaattcttcctatccacgagcatggaatgtttttccatttgtgtcctctctgatttccttgagcagtgttttgtagtactgcttgaagaggtcctttatttcccttgttagctatattcctaggtattttattctctttgtagcaattgtgaatgggagttcactcatgatttggttctctgcttgtctgctgttggtgtatgggaatgcttgtggtttctgaacattgattttgtatcctgagactttgctgaagttgcttctcagcttaagaagcttttgggctgaaaagatggggttttctagatataggatcattcatctgcaaacagagacaatttgacttcctctcttcctatttgaataccctttctcttgcctgtttgccctggacagaacttccaatactatgttgaataggagtgaggagagggggtatccttgccttgtgccagttttcaaggggaatgcttccagcttttgcccattcagtatgatatcagctgtgggtctgtcataaaaggctcttattattttgaggtatgttctgtcaatacctagtttattgagagtttttaacatgaagggatgttgaattttattgaaggccttttctgcatctactgagataatcatgtggtttttgtctttagttctgtttacgtgatgaattacatttattgatttgtgtatgttgaaccagccttgcatcccgggggtgaagccaacttgatcatggtggataagctttttgatgtactgctggatttggtttgccaggatattattgaggattttgcattgatgttcagcaggaatattggccttaagttttctttttttgttatatctctagcaggttttggtatcaggatgatgctggcctcataaaatgagttagggaggagtctcttcttttcaattgtttgaaatcgtttcagaagaaatggtaccagcccctcttggtatacctctggtagaattcagttacgaatccatctagttctgggtttatttttggttgataggctatttattactgcctcaatttcagaactcattattggtctattcagggattcaactgttactggttcagtcttgggagggtgtatatgtcaatgaatgtatccatttcttcttgattgtacagtttatttgcatagaggtgtttatagtattctctgatggttgtttgtattttttgtggggttagcgatgatatctcctttatcattttttattgtgtctatttgattcttctatcttttcttctttattagatagctaatgatctatttcatttttttttttcaaaagaccaactcctggattcgttgattttttgaagggattttgtgtcttggtagagatcttatatggcacttccattgctttgtactgttgcttggtgtactacaaattgcagtgatgcagttatagtgtttcaagtggaacatatattactgtgacactttattttacgtattaccagtgcacatgctatcatatcaaagcaagaaaagaaaagtggacttcgaatattgtatttttaggcaccatggaaaatgaattttcttattgaattagatggcaaagccttgtatttactatgtaatattactatagctatgcttaaaaattatacagtatatatcaacattatcagactaggcacataatataatatttctacctcacaggaatgcaacagtcagaaaaattggaaaatgtaacatggagtattttatcacagcagaatttcttcacaacaaaatgaaaatgaggctgcaactgaagtaagtttctgagtgttcacttcatttgttagcccaataaggaaaatcccttattgatgacttaattaaatcacatagcaaaaatacacttatttaagattgttagctttttggcaagaatagctgcttgaaatgttgaggacactggtacagcatcaacaatcaattaaaaaagaaggttctttctttttttcttctctccctaccagcacggcctgttggttcttgatgagtcaatagaaattagcaatactgctcagttgctcattcaaggagtcaatgctgagtatgggaaggagtcaatgctgagatggaagaattgtataaatagtctgtggggtaactgcaagtgagaatattttcaaagaagtttaaaaaaaacactaaatcagtacaatcttctgtggattctgctaagatacaatacaactgacagctatggatcaaaaaaagaattattggataaatttggaaagcatatggtgggtagattttctgaactcaaacagtttcagtagcatatcttagacctagatgcaataaatttccatatttcaaaatcgatttgactgtgcacttgaggagtttccacctagcttacaattggaaatgattaatctacaaggaaatgacatgctaaaaggcaaaatcaagagaacctaatagaattctggatattgttttcaagcaatcagtatattcaatgaaaatcatacgctcatgaattgcagcatttggcagtacctatctgtgtgaaaaaaattttcaaagatgaaatatgtgaaatatgcaaagtctcattacaggccaatattaacagcattaacaagtgcagaaaattcttacaatagggaactgtaataagatcactttacaggaaaggcaagctttaaaaacaaaattcttatgtatagcaccctccccaataaaacagaaacagctgaaaacctaaagaaacccacagagaaagcagattttaataagctaagtgttatcctatacaaagcatgacatttttctcattactagtcttgcattacaaaatttttacttaattatatttttaatttcatgaataaacattttgtgaacagtttctctcttcttacataagttcacaagtaatacccttgagtttgcttcctgcaaatactaaaatttattcatatttatatgaatatttacagaaatatgttttcatatttacagaaaaagtttgttgacttctcttctaggaataacttattttctgagttgattcctaggatattaaattgggttattcaatagtttctccatgtattcaacaaatatttattgaatatcatctatgcataaggaagctaccatgggaatccctttaaaaatatagatataaataatatatggttcttgtttttaagaagcttaaaattaaatgaaaaagatgagaccaggtgtggtggctcatccctgtaaccccagcactttggtagaggctaaggtgggaggattacttgagcccaggagtttgagaccagtctgggtgacacagtgaaaccccatctctaaaaaaaaaaaaaaaaagaaaggaaaaaagtagttaccagggcatggtattgtgagcatctgtagccttagctgcttgggaagctgaggtgagagaatcgcttgagcccaagagttcaaagatgcagtgagccatgatcatgccactgcactctagcctgggcaacagagtgagaccctgtctcaaaaataaacaaataaattaataagaaaaagaaaaacaaaaaacgaaatgtgatggaatgtactatataaataattataatgacagcaaaagttttaaaaaaattcctaagaagagagatgtaatgtaaatacctgagaggttctgaggaggggaagttacctttagtggtaatcagaaaagaaattagtgagaagaaactggatcatgatcataatataaagatattgcccttaaagttataaatgtggtgggagagatgttttggctcaagacagactaaagccatttctgtggaaggtctggttgagagaatggtatttaaaaagtaaagtcaattttgaatttagtaccaaagcattttttccttttttttcaaataacattttcttcatattatgtcatcacatattttattattttcttgcttatggtaaaagataattaagtatatttttaaaaattatcctttctaagtagattttcctcacattccaaaactcactaaaataatgtattttgtatctaaggttcatctccaatcctgggtgcttacagggaggtacatataggatataggttcatgttcctcagcttgacctttaagtctttttttgtcccaactatctctcaccatttatctgcgttagtggggctcaatattttaaggaacaaattacaagggcaaaatcctcacagaaggagaaatagaggaagagagaggaaaagaaaaagggagaaagagaaggaaagagagagagagagaagaggagggaaggaaagagaggggagagagagagcgagagcgagagatccatgctgtggacttaggattcaggtgatgtagttcttccaagttgcttgtgcctcatcctaagtgtattatcttatcctgtttctttcccctggtttctatgtgttttatatttgttttaattttccatgagcctttctgttccatacctatgggatacattatctggtagtgtactttgcacatgaatgatgagaaccctggagtcatgagatggtgccattttagagatcatcaatacaaatgatagtcatctgagactttgggatttaaattttcaaaaatgttcagaaaagacataggtgttataccaatgaccaggtctctaatggggatatgacttaacaggaaaggcaaattttaaaaacaaaattctgatgaatagcaccctccctaataaaaacaaaaatagtataaagacctaaagaaacccgaagagagagcagattttaaaaagtcatatatacaagatgaaagaaagggcatgtaagcagcaaaaaaaataaagtaaaaaacaaagtaacttcagagttaaaccaactgaaaagttaagttatagatgtagatcgtgtgagaatttttttaaaaagcattaggttgtcttgcaagtttgtgagcctcttatctccagatattttatagaggtaatggatattttagggagacgcatcattagaactgattatcctagatgattttaagatacctcaaaattgcataattctaaaatagaaccattttgcctcactttacttataattctaggcaattttaaagttcttcattttctaatataaaaaatgtatctttcaggtgatacatgacaatggacattcagaaactactgaccactcttgaagtcaagatgtacttttgactgagaataataaggagcacaaaacttgtcattagggttaactgtaaactagcaacttcattttacttgcagtgccatcagatatttaacccagtagaatgaatatagtccaagtcatttactatgcttgttggtttcttagagagaaatttgaggatgatagcagagtgttctgttcaacgttccaaacaatgtttcatacaagtaaagaacaaacatttcttattacacagatggctgattaattttgtttgcaagagaaacagatgctaaccctaggcattctttccagtgtcttctaaatgatttgtctaaaacaattcagcctatgttaaatcattctgggtaaattttaaaaagtaaatataattataattattattaactttggtcagagatgccaaaaatcaatgaacagcttacatgtgtattaaaaattaatataattataagagtacatggtgtcgcatgaccagagacttcctttattctcagataggagccagtctccctaccgaaataagttttaaacctagcaggaaagtgttgtcagttttgacaggactgaaacccatggcttcctaagcctttggactctaaagaaacaagtacttcgatcagtaatgacaacaacaacatcaaccacaactgcaagagttgctttttattgagtgcattccatttgtcagaaatgaatagcattatggtttgtattattttatttgatctggtgtcagttaaggaaagaaggcattgcttttcactttgacttccctctgggaaaaggaagaaattgttttagtgcaagtctgccttcattttagaactgaatggaaagatctgggaaggaaaatggtgctatatgcacacatttagaaaaaagatacagagacaaattttggaatgatgattacttatttgtacataatagtgaaacataccaaagaaagtgtcactctgttattcccccagctccttggcttagccgtcatattctcattaggattgaaacaaatatattaaaaaataagcaataaaaaataaaatttgttaaatccaggcaacgataaaaatctacattctaaaaatagctaaaaatattatatttaaagttatgctgagtgaaattacaaatatttcgaatatcaattttattgatttctcatagtagaatgacaaaatgacactgaacttcatattggttgatatttttctttaaagtactaccttaacatttttctaaaaaaagttttttcctttctcttctgccaggcaccttatgtgtacagagcattatgtttatatagttattaactatgtgagaagataataagaaaaattaatttaaaattaatttactttctgtagtacaaatataatatcctagattattaggcaatgtaagtactattttttttcttaagccagcaaacccagaagttatataaataatactttacttcctttagtctgagcaactcaaaacacttctgtttaagtaggaatttctcgttttatttggtttactaaatatatcccttcctgcaaaggattggtgtttaaaaatatgtgggatggtaattattaggtgattatatgcaaggctacattttacataaataatgtagcattcataatattttcctgccgtgccaatcataagtaatgtagccaattgctagaaataagatttatgaatgagctatatactaaagttaggaggtaattttagttttgaatttctaaacatattaaagcttatggaactgagagtacagctgaggcaggtcgtaaggtagtgaagacaggtctgtttgactcacatcaagggtatacaatctcttgctcaaccttaatgaatacaggtatttcaacattgttttacttcacagaaattatttacaactgatgttttatcaatcctaaaaaatagtgcaaatgtcactatgatatttgacaaaataaaggtattttatgaaatctcctttacccaggtcttgacatccaatcacaggactaacagggactgaaagaagatgtttcatctatactttgactcttagatatgtctgggttcacatcattatagagaaataaatgtctatccttttattcaaaaaattacaaataatctactcatactatcttatttgattctcccacaaccctgtgaacacaccaaactccatgagggcagttttttgaccatgattaactgctatattccctaactcctggctcttagtaggcacgaaacaaattattttttgaatgaatgcatgtaagcttaaccatttatatttattattatgaaaagatgatacccaataaatacatgcagtgtactatgcattttacatacaatatttcatttgattcttataaaaaccatatggattaagtataatactattgtactcattttataaatgctgcttaagatgtcaaatacctatcgcatctagattttaaacccaggtctccaagatcctaacaactatgcaaagaacattcaattcctggccgggcacggtggctcacgcctgtaatcccagcactttgggaggctgaggcgggtggatcatgaggtcaggagatcgagaccatcctgggtaacatggtgaaaccccgtctctaccaaaaatacaaaaaaaaaaaaattagccaggcatggtggtgggcgcctgtagtcccagctactcgggaggctgacgcaggagaatggcgtgaatctgggaggtggaggttgcagcgagctgagatcgcaactactgcactccggcctgggcgacagagcgagactccgtctcaaaaaaaaaaaaaaaaaaaaaaagaacattcaattcccaaatgtttattgatcttctcctatgggcctgacatggtgctaggtgattctacaggactctttggagagaaagaaagacaacatccatgctctgatggaggcagtgtactgagcatccaaaagttcagagcagacaagctcaactccgactagaaaggtgagtgaaggaggtaatagttcagttaagtcctaaaagatcaccataaagttagagggaaaaatggaagagctttctaagcagtggaaataaagtacacaaaggccagaaagtgggggaaataatagaattttgggggctaagtaaataggcatacttgaagaagcatagctctgaaactaagatgcctggtttgaattctgattggattacttgttgtctgtgtgaacctgcggaagttatttagtctctctcggtctcagcttccttttctgtaaactggatataacagctgtctctacttcatggaggttttgtgagggttaaatcacttaatacacatcagcacctggaacagtgcctgggatacagtaagcgtttaataactgttagctgtgattatgactgaaatgcacagcacacatcagaagcaaggtagaatatatgtctggaaatgtcaacagaggctagaccacgaagaaacatcattccataaaaagtataaaccagccgagcatggtggctcatgcctgcaatcccagcactttgggaggccgaggtgggataactgcttgagctcaggagttcaaggctagcctaggcaagatggtgagatctcatctctacaaaaataaaaaacaataaattacggaatgtggtggtgcatgcctgtagtcccagttacttgtgaatctgaggtaggaggatcacttgagcctaggtgttcaaggctgcagtgagctaagatcacaccactgtactccagcctgggtgacagagagggaccctgtctctattaaaaaaaaaaaaaaagtatgaactttatctgatcaggagtcatggaaaattcaactaagaaagttaaatcctttagcagatatttcgttttgttgccaatacgctgccaaatacactgaactttgttgctctggaagagttcctaatgagtagaaaatgggccaaaacaagcggcggggttgggggtcggagggagggaagaagtaccaatcaggataagccataactgaataatcaacctcttaataatgagatgacaggatttgctaaatgtaggtctggacaaagaatgtaggtctctttctccaaaatactgtgaagaaaaaagtgtatcttcttagaaagaaaagtttctttcgtgtgactagcctatgagaacacacagcccagatgggtggcagggtagctggatttcctaatagaagcttcgatggtggtcctactacaaaggtgctgatgaagtgtgtttttcttccttatactggacacaatccacaaatggaaaattcaggattttcaatgttcctttaagacaagaaactcattttagacaacacttatgcttgtgttcacctggaaaactgcaaagtcaagattgaaaggccttgatttgtccttagtcaagtcgttagttttatttctttccctcttttccaatgaccagttttattagttacagcaataaaaaaataaaaagactggtaagcattccttttggtgataaatggatttatgatatttgcaaggaaaagttgttttgctttttcctaaatgactgaggtactatgcttgtacagaagttgaactcgatgaaaacatcatggtagactcatttactacagatgtgctaagttgactggcctcaaaacactcattttcacagaaggaaattcacacaggcaacggtgagcctcccctgtactgtccctcagttacagtcacatgatcttgaaaaaacattgaaactgcagagtgaatatgccaagaattctttaattccttggccacataaaagaaagaaagaaagaaagaaagaaagaaagaaagaaaagaaaagaacattgtttaggaaaatcaggcagttgcataatgctaaaaatcccagaataaatatttttctcagtggaaaaacccagcagtctttaaaggtaagccaaggaacaccatggtgccatgactaaaaaaaaaaaaaaaaaaaaaaaaaaaccaatggaaagatgtccttatcctcggttgaaaatattccaaggaacttgctagtatttagaaatggtcttatttcctcttaagtagtttttctattaccacagtaggtttgagaaatacttctcttagaaatcactttccctaatgcccagttagccattactaccttgtttcactgaacaacagaatgattccttataaagcactataattctaattccatatcaaatattccacagagagcagagacatttatagaaaagatttccatgtacataaataccaactgcatgtgcaaaccttggggttacaaagggatcctcaagagaaaattattttatttttattttgatggatacaaaacatttcaacacatgacatcctaatattctaagtatgcatgtaaaatttgtctaacttgttctgtgaaaatgctaaaaagtagcagatgatgacttatgatctggtagttaattgcttgctaacggcaacattagttaccattcaacttcatggccctaggaggtatgttgcaacagtatttaacattactgtaatccatttgtttctttcaaagtgcaatgagctttctgtaccagtcgtacataaagggacagaatctgttctatggctcagaatctgtttttataaacaatggttcccaattagagtaacttaggaagaggagctagaatatgcaggttttgttgtctaattcatactcagattttcccttcccttgactgtcttcaacctctccatatttactaggtccttctgatgagcatttaaatgtcaggattctcacatttaaaaataactttctactttaaatttattctctggtcattgccctattttctccttcagaaccaaatgtctccattgagtggtttgaatatcctgattttctcactgtccactctctctcctcaggaacgtcaatcctattcctgcccccaacctgacaagattctttgctaaagttactgatgacctccacttactaaaatacatgaacataatttcattttattagatctgcatattagtcagagttcttacttgcaaataccagaaactaatactggataataaaggcagaacagacattgaaaacacatttggtagctcatataatcacagataaacctggagaatcaggtttggaaaatgagcagaattaaagtgatgtcaggaagccagaatttgaacactacagcgtgtactacatctgctgttggacattgaacactattactgatgcaaccgtcatccctggaaactgggagctgttgatgttactgccactgccaccacaacagactctccactgtccccgcctctgtgtatcactaaatccccatttgaagatgaatataactaattgatcaggcctaggtcagagcatgcatccttgtttcaagtgacaaggaagtaaaagtttggaacttctggctactgcagtaaaagctggcctttcaccaaaactcaaaaagagggatttttaaattaaaaaaatgggataaagatgctgagtagcaaaacaaacacaaaatgcatctacaacatcaacacaaaaaccccacaaaaaacaaaattaataaaacaagtgtccaacacagtttctcgagattattagatatgttgatgaggttctcctttttgaaatattctttcttaagtctccatgacaccacattcatttttttcttacctattataatcactcctttcagtctttttcctcctgtatctgactgttaaatgttagagttcctcacagcttggttctggacctccttcccactgttcaacaaaatttgtgtttgttttctttcatttgctccccagatccatttaccaccccttctctatcttgcaacttgtcctgcgaatctgactttcaatgcactgcatcgctggggttctcttgacctctggcttccagttggggttggccagtgtgatgcaccactaggatattgaaaagtgagaggagagaaaggtaatatatttatttctcccatttccttctgtctttggcattccataagtggttgggttattctcaactatagctcctgtcagatgcctctttccagcagttcctgatctcaacttgattctagtaacatcatttcttccctttaccatttcaggtctaaggacagtaatggcttcctactgttgacagtctctgggtttcccagcactctttgttgacttttttaaccctttctacatttctgtaggtagtttcctcaaaattccaattgagcattccatctgcttcctaacaggactctgactaaagcatgcatgtgctgatgactcacaaattcatatttgacctcctctctcagctctagctgaggatatttaattgctaacttaatatctccacttgaatgtcataatcttgctcacaaaatttaggcctcctataatatttgctttttcagtgacgggcagacatcacaaggtattaagttggaaacttgtgcaagttagaaatttggaagttacccttgatatctctctctctccctcatgtctcccaatcaaatatcaagtcctactaaagccacctcctaaatagtacctaaatccatccacttctttccatttacacttcaccagtctagttcaaaccgtgaacacctatagcctggagtactgcaaaagtagtcttattagtcttctgcatcttgtcttgtccccttccaatccatttactatactgaagccagagggaatccattaaaaatgtaaaattgaattggataatgtctctcctgagcttaaacctcaatgaggtctactctctttagataatgctcaattaccttaatacgtccttcaatagcctccatgatgtggtcattgtatacctcaacagcatcaaaccatatcactctacaccttgctcaccaaactttagccgtactggtctttttttgattctttaagcacatccagttcttcctaactttgcatatgctgtggtctctgcctagaatgtttctttcctgctttctccacctataattattattattcccaatttacaaactccagttatcttttggtatcatctctctcctcctccccactcatataatatatgaatttatatatgtagataagatatttatctctatatacctatttcactgagtataattgacacgaagtaaatttcaaagtatataatttgataaactggcataataaatatacctattaaaccatcaccactatcaagataacatatccactacccctagaagtttttcctattcctttgtaaaccctcctttccacacctccccacatgcacttctatctcctgaaaacccgattagctttttatcattacagattattttgaaatctctacaattttatacaagtggaaccaaacagcatgtatctttttgtctgtttttttccccactttgagattcattcatgttgaagcatgtatataattctttttcactgagactaatatttcattgtatacatgtactagaatttatttagccattcactttttgatggacatttggttcattcctagttttgggctattacaaagaaagctgctatggccattcatgtgcaagtttttgtgtggatatatgctttcatttctcttggctaggaatagaatggctgggttatatgttagaaatatgttaaacatttttagatactaccaatatataagataattgacatcttaacaatatagaggctgggtgcagtggctcatgcctgtaatcccagcactttgggaggctgagatgggtggatcaccaggtcaggagtttgacaccattgtgaaaccccatctctactaaaaattttagttagatatggtggcatgcacctgtaatcccagctactcaggaagctgaggcaggagaatcacttgaactcgggaggtggaggttgcagtgagctgagatcatgacactgcactccagcctaggtgacagagcaagactccatctcaaaaaaaaaaaaaaaaccataaacaaacaaaacaaaacaaaacaaaaacaacaatatagagtcttatgatccagagacatagtatatataccatgtatttaggacttctgtaatttccctcagcaatgttttatagttttcaggatataggtttgcactttttttttttggtgagaattatccctaatatttcacattctgatactactgaaataatactgctttaaaattttccatttctgattgttaattgctagtacatagaaatacaattaattttgtatattaatcttgcaactttgctaaactcagttttccgtagattttggatattctactagacaatcatgatttctgcaaataaagacagttttacttcttctattccaatctagacatcttttatttcttgttattacactggctagaacctcattgaattggctacaacctcattgaattgactagaatttccagtacaatattgaatatgtcatataaatatgagaaggtaatacatatatctgtgggcatataagacatcagaatgtttgcctcacaaagacctacattaaaaataatttttggagaaagcattgaaataataatagaaaaaattcaggagattctgcaaagaatattgaaagtattggttatcaaatagcttaattaagtttactatttaaaaaggagtctagaaataacagaaataaaaggagaaagtaaatgaataaagactaaaagtgaaaaattgaggcaaaatacaaaaatgatgaaggagaggagtggtctataaaaacaaagggatatgagaatatgtgaaagtgttttgttagagggaagatacaggtagtgatacgttcaacaaatcaatagatttaaataaatacacacttggttattatgttcagcagaactgcacaagaggaacaacaaaagaagtaatttttaagccagcagaagaaactttagtcatccaatggaaatgaggaaagaaggagaaataaaccccaaaaggatagtacaggtgcattagtccattttcacgctgctgataaacacacctgagactgggcaatttacaaaagaaagaggtttattacagttccacatggctggggaggcctcacaattatggtggaaggcaaggaggagcaagtcacaccttgcatggatggcagcaggcaaaaagagagcttgtgcagggcaactcccgtttttaaagccatcagatctcatgagacccattcactatcacgagaacagcatgagaaagacccactcccacaattcagtcatctcccaccaggtccctccaacaacatgtgggaattatggaagctacaagatgagatttgggtgggaacacagagccaaaccatatcaacagggcaaaggaaatacagatttcagatggcaaatactcttttttttttttttaggattttgttttgtcacccagtctggagtgcagtggcatgatgatacttcactgtagcctctaactcctcatatcaagcaatcctacttcttcaatctcttgagtagctataggcacatgctacaacacccagacaatttttaaattttctgtagagacagggtcttgctatatcgcccaggttggtgttgaagtcctggcctcaagaggtcctcttgccttggtctcccaaagagctggggattacaggcatgagccactgcacctgggtggcaaatattcttaatgaagaaattttagatgtattccctgtaacatctggagcagtagaagaatttctacgattgctgctattgtttaaaataatattcaaggtcacttgcatggaaagtgaaatggaaagaaagaaatacatggaaagaaaaataaatgaatctaaggaaagagataatgtaaggaaggaaataaatctgccattatttgaagatgatattatctacctaaaagcccaatagaatcacaacagcaaattatttgaaataaaaaattcagccatattagactataactgatacaaatcagtagtgcttctttaaatcagtaataactacctagtaaatagaataaaaataagaatataaaaagcctttactgagtggcaatattgcagatttataaagacaaaaaatatggagttttagactgcctttgtcgttatgtgactgtagaaattacttaatttctcagtgcctcaatttctgcatctacaaaataagaaatataattatgcctacctcatggggttgtaaggattaaatttgttaatacattaaaacacttatggtacgtgggcaagttctaagcattgtatgaattttgccatgactattatgaagaaattctattagaaaatgatagaaataggccgggcgcggtggctcacgcctgtaatcccagcactttgggaggccgaggtgggcggatcacgaggtcaggagatcgagaccatcctggcgaacatagtgaaaccccgtctctattaaaaatacaaaaaaattagctgagcgtggtggcgggcacctgtagtcccagctactctggaggctggagcaggagaatggcatgaaccaagggggcggagcttgcagtgagcggagatcgcgccactgcactccaggttgggcgacagagcgagactccgtctcaaaaaaaaaaaaaaaaaagaaaatgatagaaatatatatttcctccttttatattaaataactaaaatgataagatacaaattttctccaactaaatctataaattcaagacaaatctaataacaattcaacctttgttttatttttagagaaactcaacaaactgaatctcaaattatgtggaggaataaaagtctgtaactagctaatcaaccttaagaaaagaatttaaataagggagacttgcccactacatataagaacatactacagagccatagtaataagaataatgtgatgatacaaatagaccagaggtcagccaatgttttctgtaaaagggccagacagtaactctgttagactttgcaggccatatggtctctgtgtgaattattcagttctgctgttgtagtgcaaaagcagccatatgtaaataaattactgtggctgtgttccaataaattaatttatgaataccaaaattcaaatttcatatgtttttcacaaaacattcttcttatttctactttctaccactaaaaaaatgtaaaaaccatttttagctcatgggccatacaaaaacaggctgatttgttcaccaaatgtggtttgctaatactggaatggactgctgatattgactcatgcataaatgagaactgttaaacaagttggctggattttatctgtttgccttttgagatccagtctccaccctgctctacgacccagcaggctcctttactctagctgttggccagtgccttaccaaaggggtatgaatgggaatgaagtcccctgtagtcacaaggcagatatgactgagaacccaacccactgtaaggcttgcagaatttgcatattaatacatcttcatcttcaactagccagattctatgctaagataagagcactggtggagaaagagaagaactccaagacaagaaatggggacatttgaacagacatgggcaagactaagaactctgaacctctaatcctgcttaaccttcctggcttgtggaggcagcccctactcaagtgcctgggaacaccattaatagtccagtagattggcaatttgaagcctggactcgattgtggcctacagtcaatgaggttgaaatgctataacttccctcacaatagaaaggggttcaaaggcccaggaagatgaaaatgtggagataactctattattgcaatcgaatcagctaccctctaaccacagcccctggaagggctcaaagagcattctttaccacagagttaagaaacatcattggaaataggttctctgatataaatgggaacactggaatccctgagtggtagaatccaggtcatagtgctttgctatcagagaaaaggtaggagcaattatcacaataagctacaatgatggagtggaatcagactgttttgcacagatctgtggtgatggttaattgaacataggagacataggaattgaatataccatagtgtactagaatatattaatatacaggtggaaaaattgtaggtcttatagatataaatcttacttaagtcactgtgcttgggattcatgtactctcactcagttctcagactcaagccagttcctagatcagaatcccttgattgagaaggaggtaggttctctttgagaaaaaacactgcaatgtggtcagagatgtatactacaactcctcccctaagtattcttgagagagacctatggtcatttactaggtgactgaacactgggaaaagacaaattccaagtctttctagagctgttaagatactagttataacctgatgataatccctggaaataaacactgtggtcagagtggaagcttacgagggtcaagtgataaatggagttttcatccaattccatttccaagtgggtccaataaagactgtgagctcagtttttattttctcccctccaatctcagagcatagtgaaacttcctaactataaaggctactactatggtaagatgggaagacacaaatgaatgttcctacaactatcccttcctgtcccctcctcaccaatataaatctaatgtaataacacatccttgtgaaaaactgtacatattactcccatccctgtggaaaattgtacatattattgccataaaggcctgaaagatacaggggtagtgattcctactatattccctatctgttttactcatgtgtttggctagagcaaacaacaaataaacctgaagaaagtggtagtgtattacaaacttaacgggttgggggatgatgccaattacagctgcaggttctgatatggtatctttactaaacaatatagccactggcaacaacagctactgacctagcaaaaatatttcctatccacattcttatcagtaaagataattggaagcagttttcttgccttcatgtggcaggaaaagcagtatcccttccctgtcttagctcagtgctatgtcaactcaatttgcttctctgtcataaaacagactgagcagatatctttatattctggatatctcacaaaatatcattcaggtccattaaactggacttggagagtagaaaagaacaagcaccctaaaggtgtaccagaggatagaatttaaaatttcaggggcttgataaatgggtgtaatcacccaatgggttctccctgcccgttgcacagacaaaaataaattcactgagactgcagcattgcagtagagtttaattgatgcaaggctggcccacatgggagaactggagttatcattcaaatcagtctccctgaaggcttaaaggctagggtttttatggacaatttggtgggcaggcagctaaggaatgagtgctgctgattggttggggatgaaatcacaggggtgtggaaaactgtccttgtgtgctgagtctccctctggatggggccacaggatcagttgagtcatgattcatgagtctggtggagtcagtcagaaaggtatctcaaaaaacccaatcttatgttctacaatagtgatgttatctatagaagcaactgggcaagtcgcaaatcttgtgacctctggccatataactcctgagcagtagggattatagaaactatacctatcttgtaatcttggccacatgactcctgagcagcaaggaattagagaaactaaacctacatgttagtagagttcaggtctctcccataatcctattcttgtgggctttaattagtcttacaaggcagttttcattccctgagcaaggaaggggttaattttaaggtgggactattgtcattcttgctttcaagttaaactataaactaaattcttcccaaagttagcttggcctttgcccaggaatgatcaaggacaacttggaggtcagaagtaagatggagtcaattatgtcagatttctctgactgtcataattttgaaaaggcagtttcatgggtgaagttccaggaataatagtttgggggcacatcaggatacctcctccaaagtagagataaattgttgtactttgcactgactgaccatcacaataaaaggggcacagttctggtgagcctctgtggactttggagtcaacttatatcagatttgggtgttctgctccaatccattttcttagtaacctgtaaggttgctgttttttttgtttttattatggagatatatatatatacacacacacatatatatagtatataatattatatatagtatataatattatatatatataatcattttaaccatttttaggtatgcatttcagtggcattagtacatttacattattgtacaactgtcactaccatttatctacagaatttttatcttctttaactgaaactctatactcattaaacaataactctccattatccccttccaccaaaccctggcagccccattctactttctatctctctgaatttgattatcctaggtgaggaaggaggtcagcagcacttgttttccaagaactggctatgacccctgctgatcaaaacaggatctggctaaaatagggtgcagtaaagaaactgaccaaatacagctaaaaccaaaatggtgaaaaaagtgacctctagttgccctcagtgctcattatacactaagtataatatattagcatgctaaaagacactcccaccagcaccatgacagtttaaaaatgtcatggcaatggttggaagttaccctatatggtttaagaggggaggggaacccttccttggttcctggaatgccccatcccttttctagaaaattcacaaataacctgccccttatttagcatataattaagtagtagctataaatatagctagccagcagtctatgagggctactctgcctatggggtagccctgctctatctatggagcagccattttcctatactctgttgctctgataaacttgctttgtgacatagtttggatatttgtccctgcccaaatctcatgttgaattgtaatccccagtgcaggaggtgggggctgggggagttgtttggatcatgggggtgagtccctcatggcttggtgctgtctttctgataatgagttctcacaagatgtggttatttaaatgtacatggcaacaccccctctactctcactctttgtctctcttgcttgttactgctttcaccgtgtgatgtgtctgtccccacttcaccttctagtctccttaaaagctgaataggttccagcaccatgcttcctgtaaagcctgaagaactgtaagccaattaaacctctgttctttataaatcacccagtctcaggtatttctttatagcaatgcaagaacaccctaatactctttgccttcactttactctgtcagctccctcctgaattatttcttgtcttcctggaagacaagaaccctccctggctgagccacagttttggggtttgccagtatcataggtctttcatataagtgagatcacaatattcatccttttgcgtctggtttgttacatttagcataatgtccttcaagtctcatccaggttatagtgtgtcagactttcattcctttttaaggctgaaaaacattccattgtcaattattccaatatattccaaaaatattccaatgtcacattttgtttattcattcaatcactgatagacatttgggttgtttctactaactattatgcataatgctgctacgaacattggtgtaaaaatacctttaatgatgaatacattaatttgcttcactctagtcatctttttactatctatatgtatcccataacttcttattgtatatcttaaatttatacaataaaatttatttaaaaaaatcttttacattcctgccgtcagttcttttgcatatatatatacccagaagtggacttgctggattatatggtaattcaatgtttaattttctgaggaactaccatactggtttttacagtattgtgtcatttaccttcccaacagcaatgtgcttgtgttctaatttctccaccatcttgctaacacttgttattttctgtttttgtttgtttgtttatgtttgttttataatagcatcctaacatgtgtgacgtgatatctcattttgcttttgatttgcatttccctaatggtagtgatgttatatatccttccatgggattactggtcatttgtaaatcttctttggagaaatgtctattcaagtattttgccaggttgccagttttgagtggaccctgaagtaagaaaaggctctgcagcagattcagggtgtaagttacaatgctattaatatttggacctcatgactgagaaactctaattatatcagaaggctctgtagctggtagagatgccatatgagccctttggtaatctcccataagagaaaccctgcttatatctgtaagattttggagacaggccatgccctctctgtcaaatgcaatttaccatttggaatacagctatgagcttgctccgattgaaactgaatgactgaacctggaatgtcaaatggctacgctctcgttctctgttttgcccattatgaactcggtaataatcgaattcactgaaccataaaattgaatgtataccgcagcactctattcttaaatcaaaatggcatgtattgaaactgggccctagcacgtctggaaagcacagacaaaatgtgtaagcaagcaattcagatttccatgacacccgttcccattgctttgacattgctccttcagctttcctagagaattccctttaccagttaatggaggaggaaaaacctcaggcctgatttttggatagatctgcattgattgtcaacatcagccagaagtgtacagtttcaggctgcattagagcttgaaagatgttagtaaagtgaactctttccagtaggtagaacttgaggcaatacatatagttagaaggagagatggcttgagatacggatctacattaattcagagagcactggctaagagtttggccagctggtcaggcacttggaaataatgggtttgaaaggctaatgataagaaggtccgaggaagataaatttagatgaacttctcaaaatgaaatcaatgtagagttaattatattccatgtagatacttaacagacagcatcctctatagagtaggttctcaataatcaggtaaacaagatggacctttagtggatatcagtcaacatttttccatactaatcatagtggttgctcaatgggcccactaacacaaatccaacaatatggacttttcttcaccaaggttgatctggctaccacccctggtgactgccaaacctgccaaacgtagaggccaacattgagctcccaacaaggcaatgctccctgggagataagttggagctataatagctgcaattgttctcacaggggtagatacctattctagacatagatttgctattctaccaaaagttcttctggtagttaaaatgtagttgatacacagcacgaattatatgtcagaagagagagagctgatatacctatagcaatatgaatgtatctttaaatcccagtgctaagtgaaaaaaaaaagatgcatggtctaatatcatttccataattaaagatatgcataaaaacctgtagtatatttttgggacagcatacagataagaatatacattaaaacatataaaatagtggctattttagggggaggggaatgagagtggggataaaaagaagtcagcctaagagtaggtccatgcaaaaactgaaggatgacaatatgccataaattcattaatatgattatcccaacaactgtgtacctaaggtaaaagacagagggagtggaaaaccttaaagaaaaaaaaaaaagaagccaaagctgaaagacctttttttttgcctcctttggcatccaggactctggcaggtgacttaggtcaaattactagaaaatctcattcaggtcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggacgacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcattcaggtctttgaatcttgaaaaagtggcatgaagatgcatgacagtttagaaattattcatagtgcagtagcattggcactgagagtccaatggtggccatgttgactggtgccaatgtcattggtggcaccctaactagactactctttgcttggggtgttctgttgcaagaaatccttaatttcagactgttttctgaccctggattttgagctttttagctgattctgtaagcaacccagtcactatcttataatttgttttctgcttaggttagccagagaagatttttgtttaaaaccagtcagacttggctgatatcccaaagtcctaattgggttatagaatgcaaatagcctcatcatctggccttaagaccccttcattcttgtgtattctagatagagccagtgtttcgatttcaggcatgagcctttgcccacacagaaaataaaactagcatgacagattctaggaataaggtttagagtggcattgaacggaatcaacattttatttgtgttaactcagtattttttgtattggctttctcttagccattaaattactatcctttaaatattacctcaatattgaagaaaaatgtagagttgttagaaaacgtctattttcttgctagaaacaagcaacagataatcagtgccacattgcaattttcctaaataaaaatggcatatattgaaactgggccctagcaggtccagaaagcacagacaaaatgtgtaagcaggcaattcagatttccataatatctgatctcaagagaaaatggtccataattttataatccatatcaatgttttcattccttaaaattttctgtccttcctgagggatctctaggtattacatattgctagaaagaagttgtttgtcataatgaaccagtaaatgacttgagtaaaaagtaattaatgactttgatatgtcactaatgtcctgacgagtatctcataagctgaacatctgaaattgttcttaaactcatatataggatactggtttctattatccacatagggaactaatatctggattagtagtattttagcctgagaacaaatgacttcctggtcctattaataagttaattactactaatatattattaaataaattcatttgctactactagtacttttacaattcactatttagccttataaactattgggtccatccaccccacctccatgattatacctgtgtatagcagcaacaaatatgacgtattttcacatgtggttttccttgtttgaattctcaaaaatcttattcaaagcaacaggaaaagattcactacaatatttcccagtaaaacttaatccacaaaaatacagactctcaaaccaattcaaagggttttactgttgtatttttaaaatttcacaatctcattataagactatcacatggtgagtccggagattagcatgaagatggaagcccagtgcatgagctccctttaagactgggatctcaaatgagtctcttttaaccagactgatactactagcaaaagtctatacaatatttattttaattaaaaactttggcctggctgttaaagtttcgtaggccgtaacctgatgccatgaggctctgatatgtttcttccaaaacaaatagaaaccatgttaggacttcttaacagccttcatattttcagagaatctgactagatatttattagtgacataattatattggttaagttatcatttcatttttttaaacaaatgagataactcattgtagtgaaaaagaatattaatttgtatttaagtttaggtatagcaccatactagatttgaataaacattagaattgacttattacctaagaaaagagcaacaaatcaataggtaaccatatccaaatagcagaaatttaaaagggtaagttttactgtattcttaaaagtgtgtggttaattcgtctaatgtttaaagtaaaaacaacctgtggtaaaaatgtctcaattaggatgacattagggaaggaaagcgggaaaatggttaagcaaagacaaaaatgtgatttttaaatttctgatcaaataagtaagatagaaatctgcataaaaataagaatgaatctacattattgcattacttttttcccataactatcacggtggttgctcaatgggcccactggcacaaatccaataatgtggacttttcctcaccaaggctgatttggctactacccctggtgactgccaaacctgccaaaagtagaggccaacactgagctactaacacagcaatgctccttaggggattagttcgagctagctgtgattgtcctcacaggggtagacacatattatagacatggatttgctattctaccaaaagttcttctggtagttaaaatgtagttaatatatagcatgaagaattacacatcagaagagagacagctgatggacctattgcaatgaatgaattagatgaacacagagaaaatattcacacaattcttgtaaaatactgaggctataaaagtaaagggaaaatgatttttcacagaacctaccttgagttactgccaagacctaaatgttccaaaggtggcttaaaacatttgatgaactcaaagtacagccaggttgtgtagtccttaagcttttgcttctttataggtcttctttaacagattttatatttttaaaatggcatgaattattaacactatgagttattagatataaaatactgaagagaatgtacctattgacagttcctggaaatcctaaatacaactgcataatagctattagagaaatgaactggcttaatctgagccaatgccaaagctaaaatagatagccaaaatatctatggtctagcaaggagacacatgcataggaaataatgagcaaagagatatccgtactactcacaggaagtccctgttttcctggtggcccaatttttccagggtttcctgaaatgccatctgctccatggtatccttgtatgccttttggcccaagtaggccttgaagtcccttgataattaaaaattatttggattgtagagatgctgaaaagatgttaagatgacaaatacttttttatttattgagctggagaagtttacatttttatattttgttctaggacaaattttcctgtttcctggattccttaatgatttactatttggattcaacagataactttaaaagtttaaaagcctttaaaagttccccaaacaaaaatgccaagctgatcagcaatttactgtgtaacttttgcgccttagtgtaattctctggtgtttcttattgtgtcaaccaatattttatataattgtggagaaaagatcagctatatgcacctgtcagcttaggatagaggttatcatttcccatctgccaaaccttgtattgtgttattttcccaagaaataaattatggctattcagctgccactttgaatcagataattatatgactgaagtaaggtctgaacattttgtttctacacttgggcaactaaatttcatatgcaaggatctctgatctgaatgtgcttataatttacattcattttctctatttttttttcaagccaatacaagtcacccaaagcaggcatctaatccttggctaggggacaccagtaaagtctttgctaaagagccagtcaacacttatctgcctggccaggagaggaaactgatggtgaggtaaaagttaatctttgtgatgaaaagattaaattttttttcctaagactttttatttgtctagagaatgagaggctgagtcctctaaaatctagctcatgtcattttaattatgcttgaatatctctggcctttgtcaccattcattttgttacgattctaagttctctgtttttcagtggttcaccgtcagaagcatgagtccaccgggagggcttcataaccaggaaaatagcatccttcaactgcagggacttatatttaaacagcaagtttggttttgagttaatggtcatattttgttccctctgtgttccagcatgggtttaatttttttaaaagacaatctgatttatccaacatgatgacacaattggccccaaacttttctgcttgctaaagttgccagttccatttagaaaagcaagaaagatgaaagaggcctgttacttacaggaatcccaggtttcccagaaggaccaggagctccttttttccccttattaccctaaagatggaaagcacagttgtcaattgactgtaataatcttacttaaactgaagccatagaaaaggacactgagacctggacgctgcagcaagaactagcacgaactagttgtatatcattaggattgccatttaattttcctgggagtcagcttcttcatctgaaaatgagaaactttgacaagatcatctagtaatttccttgtagctctcaattatatgatttaagaatttaaactgtacttctaaaagggacctgaatagattatttaataaatgtccctactttcaggaagggccttgatctccttttgaaaatgctacatatttacttaattcagtaaacatttattgagtatcatgtatcagggactctgtcatgcgcttggaaggcaaaggcaaagttcctccttacaaggcacttacagtgtggtaagaagaacatgaactgatagcctaaaatgtgcttttctggaagaatagagaagagcatacttgtgattcaaggaaaagatatttatttcccacggaactgtttgtttttccatgtgtgagatgttttaaatcataattgattcagcagtaatgggtctgccaggatagttaggaactttgctcttgcaaatcatgccattgttctgatgacattctaaaagtatttaaagaagaaaatgtggaaaaggtgacttggttcacaaataagaaaaggaatcatgttgtcattaccagacacatttctcagaaatcatcagaagttctcacaaacaggataatcccactaaaatgggatgttaaatcattcaattttgaagacaaattgtgctaaagattcagtttaataataacaacaaagaaacaacttcaaaagatgttacttttttgacaaccagcttaaacattttatgaagaaatagtatatgttgtcacagagaaaaagagcatcttctctaagagataaaaatccaacttttgcaggatttgacaatggggagatataaggatcatgggttgtacttccaactttgaaaactattgtacttgtcttagaagtcactaatgcaaaatgtttctaaagatgaggaaaccagaaaatgggatagttagtgacctgggtttaattaaagtatacacatttctagagcatatgatccctataagtaaaatatgtttttcctaacacaataaaaaagcaaaataaacaaagactattttaaatagtggaaaaaagttgtgatttcagtcatcttgaaatacttattaaatagcatatgaatcataatatgcaattatgttaatcagtgtgttttttcctttacagtatttctttttatgcaacgagatatatctgttctatacttttgatttttcaaaatagacttttccttggcttttgaattttaaaatagtccaatgaaactcatggtgggggtaacagtttgaaaaaaatatgttttcagtttcaaaatcatgttttttaaacacaaaagcctgactcttaaatattaaaagtctatctttgagttaaaaaccaaggtttgttataaaggactcaagtcataaaatttatgctataaagaacagatttaaaataataataataatgtaacaaagagtttttcccatgaaaggggataaagatcctcaagctggggaaagggaaaagaagaagaaaaagagaagcgggactgttagacactgacggcaatctctgaaaagagccccttgcccctcatcctacccttgagtctttctcttttcctttttttttttttttttgagacagagtctcactctgtcacccaggttggagtacagtgtcatgatctcggctcatggcaacctccacctgccaggttgaagtgattctcctgcctcagcctcccaagtagctgggatcacaggcatgcaccaccacacccagctaatctttgtatttttagtagagacggagtttcaccatgttggccaggctggtcttgaactcctgacctcaggtgatctgccctcctcggcctcccaaagtgctggaattacaggcatgagccaccatgcctggcctgcccttgagtctttcttagggtggatagaaacactaatgctcccagataagtttggggatctgggcacaaagatgatgcctagggagactaaagtcctcattgagaagtccacataaagtacatagagtaaaaatctctgcatgacatgtctaggacagtgggattaagaatgtctttctgagtcctccaagtaccctgtatggtgtggggagcagagaatgttatttatatgtggccaagaacagaagaagatggccctgagaggcctgaggaggtcttgtacctgagatgagcaaatagctgcacatgccagcataggtcaaaatacttctggcaggagggccaaggtagatgccaatacggtgagacaatagcaactgtgggccaaaagtgatgatgtgcatttcaggggacactagtgtgaacagatgatgactgaagactaaacttattttccacctgccttccctaccatctgtaactccaaatttgaaaagagtgagtggggaaaactctaaatcaaatgtaggatatttgagtgaatggggttaaaggcagtcaatggattagatttacagtacatataaaattgtgctttctttttgcctggccagcactgaaaaataggtagagtggcccatttgaaatcagatccattttgaaaggcttctgttcattgggactgtgctggttcacagactactagagaaagcagtctgattcttttgataagggaaatattttttaatatgcaacgttaatacaaacgcttgttttttgtttgtttaaatgaggctgaaggacagttatctagatacttcactagttctaacactctttaagaaggcagctttataaagcaaaaatagatttagagagttaagcaaaaattattctttcttttttcaccaagaaatttcaattcattgaaatctggaattttgttttgggagaacaaatattttggcttgagtcttggtctttgagagtcattataggacagttcactcacatttgcattacaaaagtcttttaaaaaatgttggttctgcaattggttttgacttgctctaaatttttctttatagctgcccacagtcttatgcccaatgaatgaattggttggttaggttaaattaatcatattttacttaatttttaaaagattacaagtaataggcttcttcataataacaggagctaggaaataaagtttctagtgttgtttctgttgctaattagttctgtgattttaggtaactcataatctctctgggattttaatttcttcatttgaaaattaagagggttatccagataattttaaagggtcatttccaaatctaaaaaataaatttaaagctttgcaaaaacaagatgacagcaattggacaggacccatctggccactgaaggtgtccctagtgaataatacacagtcagtcattattcttgtagcaattaatactattttaaattctaagaggctttttaatgtgcccttgggttgtatgccagcattacccaaagcagggaagaactagcttgcctggattatacagaatttaaactatggcttcttagcaccttttagctccaacacgcagggattgttgaccatgtaggctagagaggcagttgactagtaaaagtatttgatattcattagcctaattttaacatatactaataagcatcagaaaatgtcttactcctgagacctctcaagatggaaaaagaaagcctgcaaatatgaaagtattaattgtaaaaaagtagatactttcggatcaaatgttggacagaacttgcattcttaggcacttactgcaaatataaggaagtagcatgacagcagtagcagtattctaggttcccaatgttttctatgactttttccaatttgagtattaaaaattctaagtgaatgacttaactatcttctttctctgcttgtttaggcttatcttcgatatgatatttttatttattaatattatttattggggaacctaacagaaagttactgaatagatgccaagactatacaaaatgggttctaggtaagtgaatgcctatttaacatatctgattcaaccccattttattacttactcccataagtggaaaacacaaatatgggtgaaggctgcttaacaaatcaggagaaacacaatctcaaatcattactttttattcattctcatctaatttattattaacagtgtagtgcattttcttaagaatttaatttgaaatcaatagcatgtgaagtcagaatgcctgaaaaacagggcagcaatgaattgaaggtgcaaatgacaaagttgcttgctatttaaagttgaggcaatgtctatctggccacatggaaagagaagactaaattcagtaaaccaacagatttttagtttgcttgataagatttgccttatgaaaaaacaactttcaaaccaattatgagcctgtgttacatagtcaaactactttttcctctcttatcctatgacaatgattctttgcttggtcaaactttagtcaggctcctgaaccttctaagccctccgtgtacttccttgtaaaatccagttttagcaacgaaccctgccaagtcggtttagcaagaaccttcacccttgatatctgatcacccttgatatttgatatctaactgggttcctcatcctctaccatcccccagttgatgtctgattatcccacagttgatgtctggtcaccttggcctgtcttcagcaaaattcttgttaggtcagtttaaccaaaattcccctggcccctggtgtttcctcttaagtaattttccattcactcatactcaatctgctcctttgttataaattcctacttgcccatgctatatttggtgttgagtccaatctctcttccccattgcaaaatcccattgcagtggtcgctatacctattgtaatagtcatgaacaaagtcttccttaccatgctttaacaattatcatttaataattttttctttaatgctttctacaacaattatataggtttgactgattttttttaccttataatactagttttaaggtttgctggtatttctgtttgaaacctcaagaacatactattaatttgagacaactgaggcaattttcacaaagctagaataggcttctggaaaagaaaaatttggataatagtcaaaacaaatgactcaatcaataattttgtattagcacaattattgaaaaacaccctacttagaggcccatagtgatccatattctacagtgataaatgataatttgaattacaataaatagtaactccttgtgctcctgctttctaaaattgctaacaatacatctcaaattgccttaaataatttcaacttacttcagatcctctctctccttttagtccttgttcaccctggtcacctggttcgccctttagtagaaaccaaaataaaaatcacatatgaagcagagaccaaataagttatattaatgttaatttttagaaataatgctttcaaaacatactgggggtccttgttgtccagtggcacctcttagtcctggtacacccacatggccctagaaatagaaaagattacattattagagtaagtagagacatgtgacttaagagaataggatactatcacttaaaatggtagcaaagtgttgcaaagctcaacttaaatgtcgtagagattatgattcttcttggaaatagaaaagaacataatagctgttggatattatggtagctgaaaacaagttagggttttctttctttctttctttctttttttttaatgtgaattaatgtagcaggctgaatggtggcctcccaaatgttcgtctatgtcccaatccccagaatctgtgaatgtgatcttgtttggaaaaagggtctttgcagatgtcactaagttaaggatctcaagataagattatcctggattatccatgtgggccctaaatccactaaagagcataagtgacacagaggtagactgacacagacaacagaggagaaggccaggtgaagacagaggcagagattggagagatgcggtcataggaatgctgacagccactagaaactggaggaggcaggagtgtggccctagagcctctagagggagcgtggccctgttgatcccttgattttggatttctggtctctagaactgagaaaattacatatctattgttgtaagccacccattttgtggtaatttgttatagcagcctcaggaaactaatatagtcaataaccaaaggaacagagtttgagaatacatttctttttcaacctcttcctcctccgaaagtgtactatggtctccatttttacaaactaacttcacaactatttggacggtagatttactgggctgaagactgggagcagttactgggaggtattactataataccaagaaacaccacatgactctgacattcggcaatctgtcgtcaccttagttctcctaagaaggaatgctgacctaccacatttcccttttcaagtgtgtaaatagaaactagcaacaacccagaagcgtgtcagatgagagttatgcaggaataattctgcgtgtaaattcttttatcccttttcctactcaatcagatttctttctccctattttcatacgttacagaaagaatgccttaggaaagagttatcagtcccatctcctgggctagaagaagagattgcatacataggctaacaatatttattcttttattattattattattattattattattattattatacttgaagttttagggtacatgtgcacaatgtgcaggttagttacatatgtatacatgtgccatgctggtgtgctgcactcactaacttgtcatctagcattaggtatatcccccaatgctatccctctcccctccccccaccccacaacagtccccagagtgtgaagttccccttcctgtgtccatgtgttctcattgttcagttcccacctatgagtgagaatatgcggtgtttggttttttgttcttgcgatagctgactgagaatgatgatttccaatttcatccatgtccctacaaaggacatgaactcatcattttttatggctgcatagtattccatggtgtatatgagccacattttcttaatccagtctatcattgttggacatttgggttggttccaagtctttgctattgtgaataacgccgcaataaacgtacctgtgcatgtgtctttatagcagcatgatttatagtcctttggttatatacccagtaatgggatggctgggtcaaatgatatttgtagttctagatccctgaggaatcaccacactgactcccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacgtgaagtccttgcccatgcctatgtcctgaacggtaatgcctaggttttcttctagggtttttatggttttaggtctaacatttaagtctttaatccatcttgaattgatttttgtataaggtgtaaggaagggatccagtttcagctttctatatatggctagccagttttcctagcaccatttatgaaatagggaatcctttccccattgcttgtttttctcaggtttgtcaaagatcagatagttgtagatatgcggcattatttctgagggctctgttctgttccattgatctatatctctgttttggtaacagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgcagttctccttgaagaggtccttcacatcccttgtaagttggattcctaggtattttattctctttgaagcaattgtgaatgggagtccactcatgatttggctctctgtttgtctgttgttggtgtataagaatgcttgtgatttttgcacattgattttgtatcctgagactttgctgaagttgcttatcagcttaaggagattttgggctgagacaatggagttttctagatatacaatcatggcatctgcaaagagggacaatttgacttcctcttttcctaactgaataccctttatttccttatcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaattaatggagagtttttagcatgaagggctgttgaattttgtcaaaggccttttctgcatctattgagataatcatgtggtttttgtctttggttctgtttatatggtggattacatttattgaattgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccatttcctccttgtacctctggtagaattcggctgtgaatccatctggtcctggactctttttggttggtaagctattgattattgccacaatttcagctcgttattgatctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgtgtctgtttgattcttctctcttttctttattagtcttgctagtggtctatcaattttgttgatcctttcaaaaaaccagctcctggattcattcattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctggtttctcttctgggcatttagtgctataaatttccctctacacactgctttgaatgcatcccagagattctggtatgttgtgtctttgttcttgttggtttcaaagaacatctttatttctgccttcatttcgttatgtacccagtagtcattcaggagcagattgttcagtttccatgtagttgagcagttttgagtgagattcttaatcctgagttctagtttgattgcactgtggtctgagagataagtttgttataatttctattcttttacatttgctgaggggagctttacttccaagtatgtggtcaattttggaataggtgtggtgtggtgctgaaaaaaatgtatattctgttgatttggggtggagagttctgtagatgtctattaggtctgcttggtgcagagctgagttgaattcctgggtatccttgttgactttctgtctcgttgatctgtctaatgttgacagtggggtgttaaagtctcccattattattgtgtgggagtctaagtctctttgcaggtcactcaggacttgctttgtgaatctgggtgctcctgtattgggtgcatatatatttaggatagttagctcttcttgttgaattgatccctttaccattttgtaatggccttctttgtctcttttgatctttgttggtttaaagtctgttttatcagagactacgattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgctgttagctggttattttgctcgttagttgatgcagtttcttcctagtcttgatggtctttacaatttggcatgtttttgcagtggctggtaccggttgttcctttccatgtttagcgcttccttcaggagctcttttagggcaggcctggtggtgacaaaatgtctcagcatttgcttgtctgtaaagtattttatttctccttcacttatgaagcttagtttggctggatatgaaattctgggttgaaaattcttttctttaagaatgttgatattggcccccactctcttctggcttgtagagtttctgccaagagatctgctcttagtctgatgggctttcctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccgtcactttcaggtacaccaatcagacgtagatttggttttttcatatagccccatatttcttggaggctttgctcatttctttttattcttttctctctaaacttcccttctcgcttcatttcattcacttcatcttccatcactgctaccctttcttccagttgatcgcatggcctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccatagctcggagtaatttgatcgtctgaagccttcttctctgagttcatcaaagtcattctccttccagctttgttctgttgctggtgaggaactgcgttcctttggaggaggagaggcgctctacttttcagagtttccagtttttctgctctgttttttccccatctttgtggttttatctacttttggtctttgatgatggtgatgtacagatgggttttcggtgtggatgtcctttctgtttgttagttttccttctaacagacaggaccctcagctgcaggtctgttggagtacccggccgtgtgaggtgtcagtctgcccctgctggggggtgcctcccagttaggctgctcgggggtcaggggtcagggacccacttgaggaggcagtctgcccgttctcagatctccagttgcatgctgggagaaccactgctctcttcaaagctgtcagacagggacatttaagtctgcagggttactgctgtctttttgtctgtctgtgccctgcccccagaggtggagcctacagaggcaggcaggcctccttgagctgtggtgggctccacccagtttgagcttcccggctgctttgtttacctaagtgagcctgggcaatggcgggtgcccctcccccagcctggctgccgccttgcagtttgatctcagactgctgtgctagcaatcagcgagactccgtgggcataggaccctctgagccatgtgcgggatataatctcctggtgtgctgtttttaaagcccgtcggaaaagcgcagtattcgggtcagagtgacccgattttccaggtgccatctgtcacctctttctttgactaggaaagggaactccctgaccccttgcgcttgccgagtgaggcaatgccttgccctgcttcggctcgcgcacagtgcgtgcacccactgacctgcgcccactgtctggcactccctagtgagatgaacccagtacctcagatggaaatgcagaaatcacctgtcttctgcgttgctcacgctgggagctgtagaccggagctgttcttatttggcaatcttggctcctaacaacaatatttattcttacagcaaagtcagttgaaggcttctttgtttgcattctgaggcaaatgtttacggtttaagtttcaacttcccgataaagaaaatgaaatctgtttaaggaagtgaagagtggcaagagagaaaggctagtcttgagagcttctatatagcccatgaccacactaacggaaaaaccatgatcacacacgagccttagcaaaacatgagcagagccagcaattaacagaatctggtcaatcaagacggagtgtggtacaagtaaatgtgactacttgaaggtcacttatcaaacaggattcaggaaagaagtggctggtgaaaagctggaggtgaagtaagagtgagaatatgagcaaactacaaaactctaaaccatcatgcccaattatggcttttccaccatccctgtatgtagttctacagaaatattttcagagtgatcatagaatagccaactgcctctcctggctttgtgaagtatgactgtaaatctcaccaagacaaacctgcattctaagagttttgttacaattactttggtttatcactctaaaaattgactatgaccatttttctgtattggtaaaaattaaatgtgccatagaaaatgttattacaaaattattcaggagaggttatggaaagtgatggaacttgtcagataatattagtggtgggatgagttgaatggccaaaggaacttacagaagattttataagggaagtgataagttcaatcttgaagaatgagtgttccgggcagtaaagtgaggacattctggcagaggcaatagcatgggaaataaagggatgcatctgacagaacatgttaggtagaaaatggatctgagagggctatgactggagacaggaagtctagttgggaagctattgaaataattttggcaaaaaatgatgagagcctgatggtagtttcttttgctgtgcagaagctctttagtttaattagatcccatttgtcaatttttgcttttgttgacattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcctagcaccatttattaaatagggaatcctttccccattgctcgtttttctcaggtttgtcaaagatcagatggttgtagatatgtggcattatttctgagggctctgttctattccattgatccatatctctgttttggtaccagtaccatgctgttttggttactgtagccttgtagtatagtttgaagtcaggtagcgtgatgcctccagctttgtccttttggcttaggttgacttggcaatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattgttgtgtaagaatgcttgtgatttttgcacattgattttgtatcctgagactttgctgaagttgcttatcagcttaaggagattttgggccgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgagatacgtcccatcaatacctaattaatggagagtttttagcatgaagggttgttgaattttgtcaaaggccttttctcagagtgaacaggcaacctacaaaatgggagaaaattttcgcaacctactcatctgacaaagggctaatatccagaatctacaatgaactcaagcaaatttacaagaaaaaaacaaccccatcaacaagtgggtgaaggatatgaacagacacttctcaaaagaagacatttatgcagccaaaaaacacatgacaaaatgctcatcatcactggccatcagagaaatgcaaatcaaaaccacaatgagataccatctcacaccagttagaatggtgatcagtaaaaagtcaggaaacaacaggtgctggagaggatgtggagaaataggaacacttttacactgttggtgggactgtaaactagttcaaccattgtggaagtcagtgtggcgattcctcagggatctagaactacaaataccacttgacccagccatcccattactgggtatatacccaaaggattataaatcatgttgctataaagacacatgcacacgtatgtttattgtggcactattcacaatagcaaagacttggaaccaacccaaatgtccaacaacgatagactggattaagaaaatgtggcacatatacaatatggaatactatgcagccataaaaaaggatgagttcatgtcctttgtagggacatggatgaaactggaaaccatcattctcagcaaactatggcaaggacaaaaaaccaaacactgcatgttctcacttataggtgggaattgaacaatgagaacactgggacacaggaaggggaacatcacactctggggactgttgtggggtggggggagggggaagggatagcattaggagctatacctaatgctaaatgatgagttaatgggtgcagcacaccagcatggcacatgtatacatatgtaacaaacctgtacattgtgcacatgtaccctaaaacttaaagtataataataataaaatttaaaaaaaaagtaaatacaaaaaaatggtgagagcctgaactaaagtaggacaaagtaactagattccagaaacatttaagaatcaaaagaagtggctgactgtgagacatgagtaggggtatggggaagaaaaagagattcatagagacagagtgagtgagtgagagagagagattgagagagagacagagagagggagaaagaaagagaaagaaagagagacagaggattcatctactggtttagacatctgaatggctggtgatactattcactgaattgaggacataacaagaggaagatcagattaaatttggaaaggatgaggtactatggtttggcacttactgagtttgaggtgcctgtgatgatgtccaatagctatttagatgtgtatgtctgatgctaaggagtgaaggccaagttgggatttagttatttcattgtgtgtaaaaattctatgaccattgccagcccccctccgcccacagcaaaaagaactttgagatgcaacataatttattcaaagtatttctgggacttcatctctcctaagtttagcttgagttaatcttggctatttatgtttccatttatacctttaaataaagtgtttccatttatacctttaaaaagtggctgttgccaggataatacatttattccctccatgtcctctggctctcaagcgtcaaataaatttatcttgatctatgtgatgtacagttttagtacagtttatagcaggatgacagctataattgcttttccttttatgaaataacatgaaatagctgtacatattttatagctaaaattcactatgtttatttttatactgattaagtgttcttattctccatgttttttatatatatgatgtccatgggggcagagactgtgtctgggatgtccaatgtaatatccatggcccctagctcttctcctggcccatggcagacactcaaatacaagcttaatgaccagagacatatatatatatattttttagatggagtcttgctctgttgccaggctggagtgcagtggcatgatcttggctcactgcaacctctgcctctgcctctgcctcccgggttcaagtgtttctcctgcctcagcctcccgagtagctgggactacaggcatgcaccaccacacccagataattttttgtattttagtagagatggggtttcactatgttgggcaggatggtctcgatctcctgacctcgtgatctgcccacggtggcctcccaaagtgctgggattacaggtgtgagccactgcacccggcccagagacacagtttttagaaatgttatcatacataacacataaagtatgtcagtacaactaagtattcgttaataataatgagcaggacccttgactttggtcaaagatgtttgtgactataaacatgttttttaaaagccaggtgattattcagtcataaagacaataaaatattgatatattttataacatggatgaacttttaaaacactgtgccagacacaaaaggctacatgtataattctatttatatgaaatatccagaatacagaaatccagagacaaaaagaaaaaggtttccaggggcttgggggaatagggagtgactgcctaatgagtatggggcttccttttggaagtgttgaaaatgtttggaactagacaatggtgatggttgcacatgatggcgttcaagacacactaccccaaaatatggcatctcggaatattgaatattttaagctgaagcaatctgaggaatggcatgtgcagagaggactttcttaccttcctttgatgcaggtcataagacacatgtgagaggtgtctccctatacctggaggaaaggagcatcctcatctccaaaaacgaagggacacagagaataatctgaatgaacagtccttgctaagttttccccagtttactaatcttaacccatacctttgccctatcacattcttctaagacttcctcatcaaacctagcataaaagtattcaggtttaactgtttctttggagctttatttctttatgaaggctcccgtgttacgtataatttatatgaaattaatctgtatgcttttctcttgttaatctgccttttgttaccaagtccccagccaagaattcagaagggcagaagaaaagatatttttcctcccttgcccactaacaatgtgaatgtactaaatgtcactgaattgtaaagtttaaaatggttaaaatggtaaattttatgttacatgtattttatcctaataaagaagcttggtgataatgctaaccatcagtttagcagagtgaaatcatagcatatacaatatccatatagaaaagcaaacattttaaaatatcacctgaagctataataagataacctaattctaaataaagcgtggttcctctgtataaatcaaacttgtgctaggagaaaacttggtgagggagaaaggtggatatttcatgattttgagctaagcaataaaagtagcatggttgtctggcacaagatggctaactgtttagcatagaatcatcaataaataaaatgatccctaaagcctaaggacttaggaagaaataagacagaaaggaagacatggatcaaactagtttatacaacatctacagttgaaaaattatcaggggtatacaaggaaggggaaggagaagtagattagacagtgaacctagggaaaagtgaatgactgattgtccagaaaacgccggcagggcttttctttggctagccaagtgaggaaattcttgtctcctttcaagcgaatagttaactgctcatttgctggtaaatatactgatttagctactgaatgttctgtagctggtagaggccaaaatgagatattgcaggaatctggttttcccgagactgtgtgaagaagtcatgcacagaaaaagctgaggaactttaagaggcttctcaaattatgctggaagcagttgggttggcttctcaactcggagaaaagtaaatttcaaataaatccactcaattccttgggttaggaaacacttgtagatacaaatgttatgtaaattggaaacagaacacatataacctgctaaaaatgtttctttgaaaacagaaaaaaaaatggtaatcgcaacaatttcacaaatatttagaactattctcaacatctgcttcaaagagagttttagggagtgaaagttaatttttcagattcctctggcttgagaaaaatcaacttattaatgatagttatctatctatcatcttgtccatttagtttgggtaatataaatctgcatttcagacatgaccacaggaatttcatcttgacagagatgtatcagattaattaacccatcaactcattattaaaagcttattatgtacagggattagaactagacgttgtacaagaaagaaagaagacatatgccaagtgggggagctaagacacctacacattaaaaataattagcaaaattagcaaaaaaagaatagcaacagaatgtggtaaaatgtttgtactgaatgacttaaataaataatattattacaagactacaggagagagcaagattaccgttagtgggtcaggggaaaagggaatttgagtgaaattataaaggatttatgtaagcaaagattacataatattataggcaaatagagaatgctatgagcaaaggaataagacaggaactatagggagacaggagacaacctctaactctgtaaagcaattggcaatgtaaatagagggaagagatataaggcaggaatacagaacatcctcaaaaacaaatgtgatattaaaaaatgacactgaatacgttctacacacagcctaattttagctaagttggtcagataatgtccctctcaggaatggaagaggataagaattgacttaagccttgagaatataaaggtatttagccacctacttgacacctctttattgaattcctactatataccaggaactttgtgttctagaaattgggggtataatgatgaaaatgagagacaagattttttttctcatggatcccacattttgttgggggaagacaaacaataaacaaggaaacaaatatatttaaaaagtgacaagataatatagcataaaatgtcatgaaggaaatcgagtaatatggtccagagtgattgttctagatctattttagatagggcagttagagaaggcctctcaggaggtaacatttcagttgagatctgaatgatgagaaaaagcagaagtaagaaaagacaaagatgattctaggaaggaggaacagaaagtagaaagacgtctcttctaggattaaaaacataagacattactaattatctcaataatggaatggaaaaaatggaatagaaacacagagaaccctatttaaattcattagtaaggggtataacttgcaattaccttatatccctctgctccaggctctcctctctctccttggtcccccactggaccctacagagaccacacacaaaacaatcagttttacagctggatcaaagtatatgcgaatgcaggtgataagattagtgttgtttattcttttgtcaaaaatataaaaccaaatatatgatttgtttagttccattaaataatttcaaaatattgaatttcaatgataccaagaacaacatcaaaatacaccaaccagtgaattatataaagagaatctcataatgattctactaggaaaaatattgaaaactgaagcccaattaaaaatatgaatattttcaccaagtgtggtggctcacacctgtagtcccagcacgttgggaggctgaggcaggaggatcccttgagcccaggagttcgagaccagcctgggcaataacgtgagaccctgtctctacaaataatgtaaaaattagccaggcatggtggtatgtgactatagtcccagctacttgggagctgaagcagggggaacacttgagcccaggaggtcgaggttgcagtgagtcatgtttgcaccactgctctccagcctgggcaacagagtgagaccctgtttcaaacaacaacagcagcaacagcaacaacaaaacaacaaaatgtttcaattagtacagtatgttataaatgatgcccaaataacttacttttttactaaatattaaaatgattgaaaaagatttaagcaggacagttcagtacataattccattaattacaaaagattatatttaagtgatcttttaaaagggatttaaatagtaaatcctactttaccattcttcatgagaaagtctactgttggctgggtgtggtagctcatgcctgtaatcccagcactgtgggaggctgagataggaggatcccttgagctcaagggtttgagaccagcctaggcaacagagagagaccctgtctctaaaaaaaattaaaaaataataaataaaaattagctggccctggtggcacgagcctgcagtcccagctacttgggaggtgggaggatcacttagcccaggtgtttgaggctgcagtgagccagcactccagcctgggcaacagagggagacacagtctcagaataaaagtctattgtgaaatttttaattttcaagacataaattaacctaaaaaattatacttattaattttaatccttaagccaaaaattatctaataaactcagacttacttttcctgaatatttctaatagaaaatctttaatataataaatcatcaaattatctactataaaatgaaatagaaatatcagcacccactaggacctaccatctgaacaaaaacttaaattgaaattagttggaaaagcataggatttattatagagcattaattgacaaattttaatttactcttacgtggacaaaggtaagagacatgtcaacactacaatctctgactctgctttaattatttagaatctttgtggtttaagtttcatgcctgtcccgtgtctactggataaaactactattgttatgctagtcttttaatatatttattacattttaggtggcattctttgatcctggcatacctaaatctgggaaaaacaaccactactatactccttttgccaagttttttccatttgctttaagatttttacattatttccatatatttccctctcttagtggtttagagagactagaatattatttaataaagaaacttacatattcctttagatacctatatatctattgcctctatatgagatggcttgatttaatcagaaaaattagaatctttcttgtctatttctaaaacaaagtataactttcaaccatctccaaagagccaggtcaaaatatcaggagtgactacatattctgatccttgtgccttaagattgttttactctatataatactatgtgagaaatggaaaatatagccaattatataatatttatttctatggactaaaaattttcatttaatccatttaatttacatatggtctttagacattgttttagtcaaacatgaacacagagacagttattcaaataaagctataatagctactttttagagaccatggttatagttaacccttaaaatgtttaataagaaggctatagatcagtaatctttaaaggttattggttctaataactccttagaggggttttgaaatcacttggcaactgtgtgtaaactgctataagaagtatatagataagatttttttaatatttagaaataaatctgaatgtgataattacagaaatatgtatcctaaaatgtctagagtgtataagttttctgacaatctttgtaaaagttgttatcatgccttcaatgcagaaagttagatttgggaagtcactatattaaccctatatattatgctaaaatatgacctgcatatttttcatattaaagactttaatatcatttaaattttgtgaccataaatatcaccctcctatcaaaccatgttataaaactaacaaaagaaaactccttgaaaagatttaattggtgttgtgaatctattatataattgtgttttatcttgaataaccagaattatttcagaaaaagacctactggttcacctcgaggcccaggtggtcctaggactgtgctatcttctcctgggtagccctaaaatgaaataatgatttataaacaaaactcaataaataaaataaacatcaaaaacacacaacctactatttttaagtatattagaaaatgcagtttgatgttatctttttttaagtggaaaactttgatgtaagaaactaagcctatgatattttatacagagttgtaatttgtacagggttcttcttggaggtatcaatctcctttaattatataagaagcagctcaggaattttcttaaagtgtcagatttcaatgatattgtaaattaagaatactgctgtagttattcctaaatcatcaaaaaattttaatctttaatataaatgagccaggtgcggtggtactcatctgtcatgcctgctacttaggagcctggggtgggaggattgcttgcttggtttgagtccaacctgggcaacagtcaagatcacttgatcctgactctcctgccccaaagactttaatataaatgtactataattaatcatttaatctagagccttacaatttctttaaataattaattttactcttacaaagctctacaaatattttcacatatattatttcagctcagtcttgaaacaacccatggaagatattttaataatttatttaaattttagctccttgatatttatttttttcttccagaattagtaaaattttcaactttaaaagtgcttcttttattccttgaaaatttttccatgcagtctttcaggaataattcatgaactcaatgtttaactttaagattaaaaagccaatatatacacaaaccttttctcctttaggtcctggcaatccagagggtcctggttggccctgatggccctacgaaaggacaagtagacatttatacatgctctacctagatattagatattgcattattctgaaaggaaaaataggattcactgtctaggaggatgagacctaaatatgttagaaaggtttatcagagagatttcatcttaatttgaatatttgggatatcatctttaataaaaatgttttcatgtgaatatattttttcaattataaatacttaccctgtaccctggaattcctggttctccatcaggtcccatcaatcctaaatgtccctgaaaaacaaagtaaatattagtgagagagagaaagtaaagaattgtttaaatcattagacttctactcctattgtttaaattgttacctttagatttttcatggttgaaatttacctagtttgaaataggaaagcaaaaaataaccccccaacttttgtctatttttttttctgaaacacaaaaagttctgcaacaaatgtctttttggtttacttctgatataaatatccttaatcatattaaaaaaaatactttcagttgtcagaatcctgctgctccctaacgaattattggaaatgtggtttacatctgtcaaagtttgtgccagatgtgggtcactgaatattagagagtgcaacctgagagtttttgacattgtcactacgggatccagaactccatactcattgttagtttcagatgctatgatgaatatggttttagtcctggtcaaagttattaaaagggaaatggttgacaacttacatgtaatagttaccctatgattactcttattatcaatattttatagatggtgaaaccatgtaagccaaagactaatcagcaaatgcccttagcctactgaatagattgctcagacaattgaaaaagtaaaacaaacaaacaaacaaaaaaaacctgaaaaagtcctatatttcatattagcaaaaagattccatattgactctcctatttgagtctcaaaacaaatagaagatgggaaaattaaggcacagaataggtatgtgacttgccaaatgtcatactagaactaagtctcttgattctgcatatatagtatttcccatttaatcatagtgcttcactatatttgatgatttctttaaattcccagctctaaaaatgttcacattgcaactattaaccattgattagtaaatttagactcatccagataagaacaagtttcagtctaaaaaaggaattgcacaaaattaattttaaaacatcaataagaattcagccattacctaggtgaataatctagaatagaatgtaactactcagtattcattagctcaagatggctgaatgacatatgcttgcttcaatagtctcatccaacaaaaaagagagagagaaaagaaaggtatttatttgtaataacaacactggaaaataagtaaacatcatcagtggaccaaaattttgtaatttgagacagaaaattagggctgaaaatatgcaaagaaaaaaatcattgcagatgtgcaagtagtctcaaggaaatttcaaatgctgaaatcaagacattgaaggggcaggataggttcaggtgactaactggggaaaggagtcaggtattcctattctacttgtgctgggtaactgatgattgcatttgcctagaagataagtgaatgcgtgtggaaactgttgccccaaaagcaggcaatgctaaaggctgctgctgactcaagtgactctagagccaacataacaagaaataaaatatgcaattcataaaagaaaaaatgaaccttaatgtacctaaaatatatatgcaaaatatgtaacctcccaaaaataagtggggagaaaatgtgatgaacagatctcaaaatctgttttcagaaatcaatgactcaaatagcaagaaaaaaaacagtaagaaagctataaggatttaagtagcttagctaacaacttgatttaacagaaatacttaggactgtttattagccccaaaaaaggaaaagaaagaaagaaagaaaagaaaagagaaaaaggaatcttttgacaaaatttgaatatagtagtcctcaaagaaaattttagtaaatttcctcaaagcagaaatcatataggtcacatcctctggctataatgcaatgtaattaaaaatgagcaataaaaattaaaaatctacttaaaaagaaagatcctttaagataactcttgttcaggagaaaataaactctgaaattgcaagctatttataagtaaatgatggtaaaaacacaaacataaaaatacgggaatatggccaaagtggcactcaaaagggaacaggtagcttcataatgcatttattaaataaataaaataaatgggccagacatttaattcaagaagagattaatactgaagcagaaattagtgaatcagaaaaccattttaaaaagttgagtgaaaaacaaagtagacactttgaactgactaataaaagagcaaaatatttggcaaatctgatcaccgcaaagagtaaacacgataaaacaacattagaaacaagaagaacataaccaaaggaaaaaaaattaattataagaaaatagtcatttcaagtttcacttactaaatatgaaaatctagttgaaattgatactttttgagaaaaaatttcaaaaatttattccagaagatacaaaatttgaaaagaaagccaaagatctactgctaataaaataacatttggctcagattgttttaatagcaagttttataaaacctttggagaacagacacaatatctatgttccatactgttacagagcacagaaaaatatgaaaaatttaccaacccattttatatgacttgcttaacacttatgcctaaatccaatcaatgatagcatacattaaaaaaggatggaatgaagaacgatggaatgaagaaataggcctactttgcttacaaatacaaatgcaaaactcttaaggtaaactacattcaataagctaaaataaaactcttaaataaaatgttaaaaaatgaaatctatttgcattaaaataataatataattaaacctaagtaagatttatcctaggaactcatggttgattcaacttttggaaatctatgaaggaattttcttatatttacaaacaaaggagagaaagcatgggtttatctaaacaaatgttgtaaaaggatttgataaaattcaacatctactatgggattatctaaaaaaatgttgtaaaaggatttgataaaattcaacatctactcttggtcaaaactctcatttaagaatgaaaataaatttctttaaacaaataaatggtatatctaaaaaacaactgtaaacaacacttgatattataagcattagaagcattttcactaaagacaggcccacaagacaaggttttcttcatcatgacttctattcactgctatagtagaagttctaatcaatgtagtaattcagagaagcaaataaggggaggcaatattatttacctgaagaatccctatgagaatcatctacattcgttaaagtggatataagatcaaaatataatagcaccaacagcaccactaagttgatgtaacagaaaaaggattatattaacactgagaataaaactcaaaagcaaagcaaaacaaaaaaacaaaaatactaagaataaacttaacaagaaagattaaagaacagagataagggaaatattttattgatgaatatgtaagcagatttgagtaaataaaaagacatatggtgtttatagaaagattcagcattgaaggaaattgaaagttcacatgaaagaggaaatcatagcaagagtcaaacttttttgtaaaatgaattatgaagtatttgccctaacagaaggtatcacaatagtatagtaagtaaaatagtgtggtattgacccagaaatagactactagattcagagaataaagtagaagaaaaacagactaatgaatatttgagaattcagtttatggtaagggaagcatttcagaaaagcagaaaacagactgaccactcaataaatagaattggaacaactgtctataagtttggaaaaaataaacttagtcttctacaccttatataaaaaaatacccacaaaaaaaccaaaaacctccatacatcttaaagagttaaggtaaaaataaagttataaaagtattagaagaatatggaagaatattcttatatactttaggtaggggaggcatttctaataaaataaacacagaaactgaaagggaaaagactgacaagtttgactatataaaaattaaaatgatctatacagcaaaagatatacaaaattaaaagataaattgcagaaagaaaagcatttgtaatatattttgtaacatatttaacaaaaatatattaatattttaagcatataaggagtgattgcaaatcaataagaaaaaggcaacaatctaatgtgcagtatatatgaacaggcaacttccataagaaaaaagtgcaattgggaaagtgtaaatagaaaaaatgcaatacacattctcacttatcagattggcaaacatcaaaagaagtaatatgaaatgttgatggtgggagtgcaaatttgatgaaacctcttgggaaggtaggttgggaacgtgtcaaattaaaaaattaataacattataaaatgtttttgtatacaggtcaaagacagagaaatgctagtaatttaaatgaaagaaagtaagaaaggcctagatcccagtaaggaatagaataccgaaaataagcctgaggcaaactttcctcagacaacaaatggattatgcaatgatctctaaaaagccttagtgaaaagtctagcacttgtgacatttaaatggagactacactaaatggaaatacgcatgcattttgtaaaaaagcctatgaaacagaagactcaattagataatcttttaaatattttgcatctctttcatgctgactttcagaacaggtctaaatacattcgcaatataattttcctaatataagagttcataagtatcatgctacacttgttcctaacatcatgcaaagttcctgagaaagatgaaagataaaattagatgttagatttatcacaattggttagaaaaataatatccaaataaagcaggtttgtttccaaccagagaaagaaaatccatttcaagtaaacctaattttcaaagcaatttgtcaaccatgacagcatagttttatacagatactaaatcccaattttaagtgctggccatataaaatttcctagtttggttaggagttataatcttactttttaaaacctcatttcatattttatttccattttcatttttttctctttcctttttcatgtccagaaaccactaagccgtttaagtactgtggaatgcttacaattctccacatcccatggaggtagattattttcaatggaactattgctttgtctgtaaagctaatcaagggatgaaactttaagggcatggatacgtttctttcccatccacagtgactcaattctggaagcaagtcaaatactgaccacagcacctctagttcctctggcacccttaggaccacttttcccaatttttccaggaggacctctgcttccaacttctcctgtgggtcctatttgtcctttatcaccctgtggatgacattattaagagagaaaagcaagaaaaaaatttatacttagattaattaactatatcatattcctgaatagctcctgaggattatctggttaacagtattacagatcactattaacaacaataacataccatcactatataagttattttaaaaataaaagtaattttggaaaaagataaaataaaaattttgaccaaacaagcagggggcatctggtgctcatgttgaatccaaataaccgttttttacttttgaattttgctatatatgtatgtaagtatgcatgtatgtgttgttactataagaaatcataagctctttggaaagtctgtttctatagagaatttcaatgcaacaaggtctgttcaatacaaaaagagctccagtgtgcagttctgtacattcaggatcatcactcattggcttggagtatgccttgaaaaatctgcaacatttttacatcactttacatctttcagaaaactaattatcttctgttttctattagacacactgacctttcttttttgttgttgttttttttgagaccaagtctcactatatcacctaggctggaatgcagtggcaagatctcagttcactgcaacctctgcctcctggattcaagcgattctcctgcctcagcctcccaagtagctgggattacaggcacccatcaacacgtccagttaatttttgtagttttagcagagacagggtttcaccatgttggccaggctggtttcgatctcctgacttcaagcgatccgcccacctcggcctcccaaagtgctgggattacaggtgtgagccactgcgcccagccaacaaactgacctttctttagcaccaaaatatagctgttcttaaacaacattgtgttattcttcattttcctaagtgagaaccaacctgttctattattgataaacaagaagatacaaagaaaaactactgtgaacacagttggacaggaaatttttgggattcataacagctaagaggctttattttatttttccaggggtgcaggttgttattatacaaagacttgcactgtctcactatgaatgttgattttagtaaaatatttttagtaaaatataaagtaagcaaataaaaatattcttgatttgtagttcttcatatatggaaaaaataaaaccaacttagaaaaacacattgacaacaaataattatagttacattctcttccctcaaatactttactaaagttgtcattgaaaagcacaaatggtatagtattttccttttatctttcttcttgcccatggtctactaaaagaatttttggcaaacaagagaaagaaggaaaagccaagattttttacaaactacaaaatggaaaatttgccttcaaataatcacgataataagtactcctaactgaaattaaatattaatttatataaatgtatcttttaaagcaacatttataattctttactactttactatctagtccaaattaaaaacattacagcagtctatggagttctgggcacatcagaagaaagaaaacctgcataagaagatgtaaaaaattaccttttttcctggacgacctctttgccctggaattcccacaattccttcaggtccctaaaatattcaatataaaaaaggaaataaatggttaaagaaaagatgagatggagtatttgaatacttctatcagataatcactggattggattggacgagaagtaaaaatgagggttaattttcacattattaggtttgtatcatttaaaaagaggtcacaatgacttagaggtgtagctgttattagctataaagttcacatgcacaaactggccaagagagtcttaattacactgttcattattctaggtggaacattacttagattcagtatacccattttaattagagagaatgtaattaaagttaacccatgccttctacgtcacaggctgtaaaacacgtttaactaaaataaaaaagtataaacccaaaggcatccatctcagcatttctatcagctactgggagctcagcatcttgtggaaagtacaggacttctgcctatccaatgaagtctccacacacatatgaaagaaagtacagagtataaaatacatctagtacatggtcaaggaaaatttcaatgtgtctagtacgtggtcaaagaaaatctcaaaatctcactggagtagaaagagttaaagagatattcgttgatctgtgggaaaaaaagaaggaaatacagagagaaaaaggaggtaatcatataaaacttaaaaataatattttcatttcaatttgtcctttgtgtagctaaaagtatattaaaagttttcaatatacacttttttttaagtaaaagtggggcactatatgaattttcaggtaaacaatggttaggcttaagtgagttccacagtaagccaggttgcaagttctaaaatggctaataattaatcacaacattccctgcattcgctggaaatgaaaatagaaatctcaaatttgtgtcccaaaagcttggcaaattgcaaaaatgatgtagacaagaaataacttgtggtttaccactgtgctatgtaggctctagataaatatttgttgaacgaataaacagatacctaaggaaatgactcataccctatgctcctgagaaaatgctcttctagcctcagaaaatcactgaatttagaggccaaagctgttgtgctctattgctgtagttatagctgcatccagaggtagaaatggtagttgcactaacctgaggacttctttgaagttaatgaggcctttcaaaaagaggctgattaatcttcatagagattaaaggtgtgagcttttaaaagtcagactgctcccatttcatattctggctctggcacctaacacctacctatacagccgtaggtagattatttaatttctaaaggcctcagattcctgttaaataaaagaggtataaaagaacatcttcaaagactaagagcaaataagagaatgcatgtaaactttagaaaggactagacttatgatgaagagctcaaaatatgctagtcgttattaacttctgctgtttattaaaagtgtattacacaatatttaagtacatgtaaagatgttaaaaggtacaatgaaagcccgtttacctacatctactttaagaaatagaaccaatatatgtgtatgtctatgtgtgtgtgtgtgtgtatatatatatatatatatctacatatatatatacatataattgaagccccacattaaacatatacttatccaaactcatcaccctttttccctactcaggtgcaatcattgtcttgaattttattgttcctacacatttcttaataattttactccatttgtatccccaagtaatatgtattttgtatctttaaaaatttttaaaaagcagtatcatactttatgtgttctcctgaaacttctttttaacacatttttgttttgaaattactgtgtctttaattcatttacttaaaaaaatgctacaggattccatgttattatcaaaccacaacttaagtatttttcccgttggttaatgttttggtggctttcttttgctattacagacaatgctggaataaacactctgtacttgtctctatgtgctcatgtcaagagtttttatagggtatgtaccctggaattgaattgctgggttgtaggatacatgcatcttcaagcatatcagatattgtcaaattgttctccaaagtgattttgccaatttacatcctcaatggcaatgtttaagagttccacttacttcatatttcctataatgcttgatcgtatgagacttaaaatgggtgcagaatgatgttatcatttcaatttatgttattggttattatggaaaaacgtatagctactcataaagttatcggacatctatatctctatgtgaatttctggttcctatcttgtgcccgttattctactgggctgtcttatttagttacatgtatatgtttttatacatacttatattttgttcattccatatatcacaaatctcttctcccagcttgtatcttattttctcaccttgtttattacgactttggactaacacaagtttgcaattttaatgcagtcaaagtcattaatattttctttctgtttcttttagtgctttgttttaagaaatctttactgcttcccctttccttataaggtcataaaatattatcttaaatgttctcccaagagttttaagattttgattttaacagttaagcctttaatcaattggaatgtaattttgcggggtgtgtgtttgtgtgtgtgcgcgcacgtgcgcatttgtgtgagggagagtattttttttttcatttggataaccaattgtactggtatcatttattaaattgttcatttccttatagatctgtagtgcataatcaatttatcaaaaatcaagtttcaaaatatacttatatctgattctacattatcttcaatttccattggtctgtttgtttatttgtgaatgagtatggcactaactaacttaattactctagcttcaataataagttatatcagataggtcagattctctcttccacctcctccacaaccatcccacctctgcacaacttattctttaaagttgtcttaatattggccctttggttttccacacaaatttttaaatcactttttatcaatcaagttttattaaaaatcccattgggattttggttgaaattgtattaagtgtattcattaatataggagaagattgataattttataatattgagttttcctatcatgaatataaaataactgtccatttatttagttctttaataaatgattataatttctttaattgcaaaaattttccacaccatttttacaaatattttgtttagatgtattgctaggtacttaattttgtggctaattgtgttggaaattgcatttaaaaatatctaactgctcattgctggtgaaaaagaatggaacctatttttgtatattacttttatttatttatttagagacattgtcttgctatgttgcccaggcgggacttgaactcctaggatcaagcaatccactcacctcagcctctcgagttactggaagtacaggcgcatgccacagtaaccacagtattatgttttattttttctatctaacttttattttaggttcaaggggtacatgtgcaggtttgttatgtggataaattatgtgtcacatggatttggtgtacagataattttgtcacctaggtaattggcataatatctgataggcagtttttcagtcctcaccctcctcccacccttcactctcaagtaggtcctgatgttaattgttcctttctttgtgtccatgtgtactcaaggtttagctccaacttaaagagaacatgtggtatttggttttctgttcccacattaatttgcttaggataatggcctccagctgcatccatgttgctggttaaggacatgatcttgttctttttctatggctgcataggattccatggtgtatacataccacttttttttttatccagtccactgttgatggagatctaggctgattccatgtctttgctattgtgaatggtgctgcgctgaagataaatgcgcatgcatctttatggtagaacagtttatattcctttgggtatatacccagtaatgggactgctgggttgaatggtagttcttttaaagttctttgagaaatctccagactattttccacagtggctgagctaatttacattcccactagcagtgtataagtgttcacttttctctgcaacttcaccagcatgttattttttgactttttaataaaagccattctgactggtatgagatggtatctcattgtggttttgatttgcatttctctaatgattagcaacattgagcattttttcatctacttgatggccaaatgtatgtctttttttgagaagtgtatgttcaagtcctttacccatttttaatgggtttgtttgttttttgcttattgatttaagttctttatagattctggatattagacctttgttggatgcataatttgcaaaaactatctcctgttcttaggttgtctgtttactcttttgacagtttcttttgctgtgcagaaactctttagtttaattaggttcatttgtcaagttttgtttttgatgcaattgcttttggaatctttgtcatgaagtctttgcaagggctgatgtccagaatagtattccctaagttctcttctaaggtttttatagttttaggttttatatttaagcatttaatccatcttaaattgatttttgcatgtggtaaaaggtaggggtccagcttcaatcttctgcatatggctagccagttatcccagcaccatctactgaatagggtaaactttccccattgcttgttattatcggctttgtcaaaggtcagatagctgtagttgtgtggctttatttctcggttctctaacctgtttcattggtctgtgtaactgtttttgtaccagtacaatattgttttagttactgtagccttgtagtatagtttgaagtcaggtacttgtgatgcctccagctctattcttcttgcttaggattactttggctacttgggctcttttttgattccataagaattttagaatggcttttgctaatgctgtgaaaaacgttcttggtaatctgataggactggcattgagtctttaaattgcttttgagaagtatggccattttaccaatattgattcttcctatccatgagcatagaaggtttttacatttgtttgtgttgcctctgatttctttcagcagtgtcttgtaattctaattgtagagatctttcacctccctggttactgtattcctaggtttttgttttttttttttgagataaagtctcgctctgtcaccaggctggagtgtagtggtgtgatcacagctcactgcaacctcacctcctgggttcaagcgattctcccgcctcagcctcctgagtagctgggactacaggtgtgcaccaccacgctcagctaatttttgtatttttagtagagaaggggtttcaccatgttggccgggatggtcttgatctcttgacagcgtgttccacctgcctcggcctcccaaatattcctaggtattttattctttttgtggctattatgagtggcattaaactcttgatttgtttctcagctgggatgttattggtgtatagaaatgctattaatttttgtacgttgattttgtattctgaaactttgctgaagttgtttatcagatctaggagcctttgaacagagactatagggttttctaggtacagaatcatataatctgcaaaaagagtttgacttcctcttttcctatttggatgccttttatttctttcttttgtctgactgctgtgactgagagttccagtactatattaagtaggagtggtgagagttccatctctcaaggggaatgcttccagcttttgcctattaggtataacattggctgtgggtttgtcatagatgacagttattattttgaggtatgtactttcaatgtcaagtttgttgagggttaacattgaggcacgttgaattttattgaaagctttttctgtacctattgagatgatcatgtgttttttgtttttagttatatttatgtgatggatcacatttattgatttacatatgttgaaccaatcttgcatcccaggaataaagcctacttgatcatgatggattagctttttgatgtgctgctaaattcagtttgctagtattttgttatcgattcttgcatctatgttcaacagggatattgacctgaagtcttctttttttgttgttgtatatcagaatgatgctggcctcatgcaatgaataagggaggaatccctcctattcaattttttggaatggtttcagtaggattggtaccagctcttctttatagctctggtagattatggctgtcaatctggtcctgggcttttctggttggtaggtttctaagtcactgattcaatttcagaactcattattggtctgctcagggtttcagtttcttcctggttcaatcttgggaggttgtatgtttccaggaatttatgaatttcttctaggttttctggtttgtgtgcagagaggtgttcataatagtctctgagggttttttgtatttccgtggtattgatggtaacatcccctttgtcatttctgaatgtgtttatttggatcatctccctgcctgtttttctttattagtctagctaatggtctataaatcttatttattctttcaataaatgaagttttggttttgttgaccttttgtatgttttattctcatctccattttgttcagttcagctttgattttggttatttcagcttttgggtttgttttgctcctgtttttctagttcctctaggtgtgatgttatgctgttaattagatatttttctaactttttaatgtaggtaggtatttagtgctataaacttccctcttaacactgctttagctgtatcccagagattcttgtatgttgtatcactgttttcattagtttcaaagaatttcttgatttctgctttaatttcattgtttacccaaaagtctttcaggagcagactgattaatttccatttaatggtatagttttgagaaatttgtattctaatgattccctaattatatcacctgttctcactccatcactgactttctgattaccctacctaatgatagctctttgcatttgtatttggtatgttaaactttacgcgtccaaaaccaaagtctctaaatccctcctcctaaccctaaactgctttcctcctactcttccccacctccactgtaataaggcaaaatttgaaaattagtaaaatggttttctttcttgcctctttgaatatgaggagtttgcctgttcagcctcaggtgtctgtacgcccaaaggctgaatgccttaaaataatatttttctgttttccttgtttccaacttttaacatttcatgagttgagtctggagcacctagcacacaaagctgtcctgtgatagagaagacactttccatgtattaccataaggcttttactagatgatagaaggatgaggatatgacataggggaagtaaagagaagcatggaggttttgtttgtctgtttgttttggctccaggagaatgtgggaaggcaaaggaggagagagagacatattttcctttttctgagttttgtcagagagagatcttttttgcaattactcatttggaatttgaaaggtatcttttgtagatatcacctggtgggtagccctgtcaatatggttactcaacaacaaagtcaaaatgaggaagaccatatggttaaattttcctgagctactcttcgattcctatatgatgtagatggcaactcagaaacagctgggaagtttgtggcagggacagggtgatcactactctaggaatatatagctctacaataagggctggagagcaggtttccttggctagtactgaataaggaccacaacagacctcagagacatctatagaaattagtgggacctgatgtgagaccagttcagcaagggaaccctcttctccaaaaaaaaaaaaaaagaaaaaaaaaaagacaaagaaaaaaatgaaaattactagatgtaaacatcatcagcagaaaccatcagggtaggcggtgagggaagattaccctgtcccaattagcacaaataacacctgcatcaatatccaaggcatcctcatccttgcaatcacaagacacacagactcaatgttggaaaggagtaaaagagagaggtcaaggactgatacacttgagagactaagcatcttgatagtctgagcacctgaagaaactactactttatatgattagattaagtttaagcattcaactgagtcagattttaaattttctctttgcctgctgccatcccccgcaaccccaatgcattccactaatcagtaagtaggagcttgtgaggaaaaccagatgagccagaaataaagaagttacatatttgcacatctgtaagtacaaatttgttgctctgttacacatttaatggcatgattatccactcagttgctcaggctaaaatctagggtttattatttattactttatcccatcttctcaacatctaaaccaggagcaaattcagttagctatgcctctaaaatatgtcttgaatctgatcattattcactatcactgtgttttctcattccaagccaccaacatttttcatctagactactgccaaagctttataagtggtttggtccacttttaaccccatagctcacttcttcacaatagcccaaataatcactaacaattttaatcatacccttctgcctgttcaaaaccttccaaatgactgtccattgcaatgagaataatcaccaaacctcttatcatggtctataattccctatgatctggctcctaccatttctctgacatcatgttttccaattatttactataatctagatacagggctctttttcatttttttcttttctttttaaaaccccttctgccttagggcctttgcgttagatattccctctatttagaaatctcttttcctcagataatcacataggtggctttctctatgcttaggtgcctggctcaatgcagcctcaggtagtacttctgtgaccaccctaaataggtaacccctttacctggtcactccacatcccaataacatattttctccttattttctccctccttccttccttccttccttccttccttccttccttccttccttccttccttccttccctccgtccttcttccctccctccgtccctgcttcccttctttccttctttccctttcctttccttcttttcttttcttttcggacggtcttgctttgtcacctacgctggagtgcagtggcatgatcatggctcactgcagccccgaccttccagcaatctcaagcagatcctcccaccctagtagctgggaccacaggtgtaagccaccacacccagcaaattttacaaaatttttggtagcgatgggggttctttatgttgcccaggctggtcttgaactccacggcccaagtggtcctcccgtctcagcctcccaaatgctgggattataggcatgaatcactgcactcaatctttatttccttcacagcacttatcactaccagaattatcactcatgttgaaattgtcttcccacattagaatacaaattcctacaaatttcatgacagcatgaaccttgtctgttttgttcactgctgtaacattaacattcataactgtgcctggcttaataaatatttaatgaatgaataaatgaatgacagaatgtatgcccaaaattgaaaataattagccctaatcagacagtaaggtagtctattaggtattcacttgtaagaaaataacattttaaagaacatgcattaaatgttgaaagtaaaaccaaagtttatgagtaaaaggcaaagtagagtgagagattttcataatattttttagcttctagggaacagaacatatgaatctattaggaattttttgcacagtaaacttctgcacatatttaaagaacccattatatgtgagaaaaggggttgcgttattctatattgtattttcttgttattataatcagaaaggtcccccctggttatttgttcagtatttttctcttcaaggatatgttgttgttatattttttttaggaggaagtgtaaatttccactgctagtaggctggtttattttagtgcttttcctgaaatgtgtaagtaatattttgctccaaaatgttggcttttaaaagttaacattgcccactgcaacccatttgtgtatctagaggtttgcagggcatataggaaaaatagcaacttttttttactatgtacatgttaaaatggatttattcaataattacagaaagaagaatgctatttttttggtgtgtgcctatagtcccagctatttgggaggctgaggcaggagaattccttgggtccaggagtttaagtccagcctgagcaacatagcaagaccgcatctctttaaaaatgctattttatacaatttatatatgtcatttatctatgtcatgttgattgagaatagtcagcttggtgttgcttactaataaaatagaggaaccagttgggattccctattttagactttgtgaaagtagctattttgtctcagaagtatcacatcatatctatttttaaaacagatttattgaggaataattaacatttacatatgtgatagttacatgatactatatactcatacatgatatccacgtatcatgtatatgaattatgtgcccatttaatgtgtacaattagatgatttttagtatattcacatagttgtgtaaccatcaccaaaatcaattttagaacattttcgtcacttccccccaaaatctcattatcataagaagtcactccccatttctttccaacccctctagccctaggcaaccactaatccactttctgtatgtatagatttgcctatttaggacatttcatataaaagtacaatatgtgggccaggcacagtggctcacgcctgtaatcccagcagtttgggaggcagaggcgggcagatcacgaggtcaggagattgagatcaacctggctaacacggtgaaatcccatctctactaaaaatacaaaaaattagccaggcgtggtggtgggtgcctgtagttccagctactcgggaggctgaggcaggagaatggcgtgaacctggcaggtggagcttgcagtgagccaagatcgtgccactgcactctagcctgggcgacagagcaagactctgtctcaaaaacaaaaagaaataaacaaaaaacaattcaatatgtggtttctagtgaattgcttctttcatttagcataatgttttcgaggttaatccatgctgcaccatgtactcgtacaccattcctttttattgtcaaataatatttcgcatgttatttattaattcatcaggtgatgcccatttgggttgtttctactttttcgctcttataaatcatgtgctgtgaaaattcatgtacaagcttttgtttaaatgcaattctcttggacatacgtacctagaagtggaattgctgggtcatatggtaagtccatgtttaacattttgcagaaccgccaaactggtttacgaagaaactgcagattttatatctcatcagcaatgtataagggttccaatttctctatatcctcattaacactaaccatcctagtaggtatgaagtggtatctcattgtggttttgatttgcattttcctgatatttgtaatgatattgagcatcttttcatgcacttattagtcatttgtatatcttctttggagatatttaagtctgtccatttttcacttatgttaattatcttattatcagattgttaatatattctggatacgagtcccttatcatatatgattttcaaatattttctcctattatgtgggttgatcttttactttcttgattgtgtcctatgaaccaacaatcttttaattttaatgaagtccaatttatcttagaagacgtactcccatgttttcttctaagacttttacagttttagctcttacatttaggtctatgactcatttggagttcatttttttctgcagtagaaggaagggttcaactttattcttttgcatgtggttatccagttgttccagcactatttggtgaaaagaccattctttctctcactgaattgtcttggcgtatgatgtgcttttctaagtgaaatttattttgttcttttcctgtaattcgtttcatttcttgagatagccaataacactaaccacactttgaataaaacccaaatttcttatcatagcttaaaaagtccttcatgatctacttcctacctatttcttcaagctcatctcaaacaacttttcactatttattatgctgcagctgtaatacccttttagttttctaaaaatactcagctcattctcacctctatatcttggccattgctgcttcatctatcttgaaggatcttcccacagttctttgcttgatgggttcctttttactctccatgtctcaatgtaattgtcccctattcagagaagccttctctcactaccctagctgatatatgttctctatctttaactagttggcttttctacccataatcagttattctctttcattagtatgtttatttccattattgcattatcacaatctgcagtgatcttttaatctttcagtcttcttcattagattataacatttgaggatcaggaaacttggtagtcttgttccccactgtatccctaatgtttagcagagttcttggctcatagaaggtactcaaaaacttcatcgaattcacaaatgaacacaaatattttatagaatcacagtctgtaaggctgaataaaagtttagaaaatctaagacaatgaatttttttaaagccttagaacctttacttccaaagaaaatctacgttaaaaatctatgttaaaaagacatacaaggaccattcctgactgatacaggaatagaaaaaatggggccctgctaacttagcatccctcctgacacaatcatcttgggaagttctgcatagctccaacccgtttgttttgtgtcatgtgtgaacatataaatcaaagaatgactcactcaacaatgtacagctctttagtgggagatgagggacacagtggtcagtgcagggcttgctatttgtgttgctttatgatgaaactgttcagaataaacaagcctaacaccagagtcacagaaaccattcagatgataaagagttagataatcatttactccataatgccacttaatgctgaccctaaattcccaactgattgtttccaaggaaactatgttagaaacaagaaacacttctgtgaagaaagtcaatggtagcttgatggggatggcattgaatctataaattaccttgggcaatatggccattttcatgatactgattcttcctatccatgagcatggaatgttcttccatttgtttgtgtcctcttttatttcattaagcagtggtttgtagttctccttgaagaggtccttcacatcccttgtaagttggatttctagatatttgattatctttgaagcaattgtgaatgggagttcactcatgatttagctctctgtttgtctgttattggtgcataagaatgcttgtgatttttgcacattgattttgtatgctgagactttgctgaagttgcttatcagcttaaggagattttgggctgagacgatggggttttctaaatatacaatcatgtcatccacaaacagggacaatttgacttcctcttttcctaattgaataccctttatttctttctcctgcctgattgccctggccagaacttccaacactatgttgagtaggagtggtgagagagggtatccttgtcttgtgccagttttcaaagggaatgctagacttcaatgttagatctaaaaccataaaaaccctagaagaaaacctaggcaataccattcaggacataggcatgggcaaggacttcatgtctaaaacacaaaaagcaatagcaacaaaagccaaaattgacaaatgggatctaattaaactaaagagcttctgcacagaaaaagaaactaccatcagagtgaacaggcaacctatagaatgggagaaaatttttgcaatctactcatctgacaaagggctaatatccagaatctacaaagaactcaaacaaacttacaagaaaaaaacaaacaaccccatcaacaagtgggcaaagtgaacagacacttctcaaaagaagacatctatgcagccaacagacagatgaaacaatgctcatcatcactggccatcagagaaatgcaaatcaaaaccacaatgagataccatctcacaccacttagaatggcaatcattaaaaagtcaggaaacaacaagtgggggagagaaggatgtagagaaataggaacacttttacactgttggtgggactgtaacctagttcaacaattgtggaaatcagtgtggcgattcctcaaggatctagaactagaaataccatttgacccagcaatcccattacgggtatatacccaaaggattataaatcaagctgctataaaaacacatgcacacgtgggtttattgcagcactattcacaatagcaaagacttggaaccaacccaaatgtccatcaatgatagactggattaagaaaatgtggcatgaacacaccatggaatactatgcagccataaaaaaggatgagttcatgtcctttgttgagacatggatgaagctggaagctatcattctcagcaaactatcgcaaggacaaaaaaccaaacaccgcatgttctcactcataggtgggaattgcacaatgagaacacttggacacaggaaggggaacatcacacactgtcgtgggatgggggaggggggagggatagcattaggtgatatatctaatgtaaatgactagttaatgggtgcagcacaccaacatggcacatgtatacatatgtaacaaacctgcacgttgtgtacatgtaccctagaacttaaagtatatatataaaaaatagacattataaacatttgctattaaaaaaagaaacaagaaacatatatcttatcattcttttctaactattgataatcttctcatctttatgacttcacttttaagatcttatttaaaaaacttattggagaaggtcactttatttcattttatcttcccttaagatatttacctctacctaatatcataccaccttaaacagatagtaaaaaccacatttcaataaatccaaccaaattttgtcctaaacatataaaacaggacaatttcattttaatacatccaactttggagtttatagttgcaaatctgttcagatcttagataacacagtggtagattttttagcatagataacagaccgtaagtcaggcagatgtttcctttcagatgcttcccaattcttttctcatgcagagttatgcatttaggcaactgaacattttagcacaagattcaagcataaaatatacaatttttttttctgtttaaagaaatctaactcctggatttggaattcattactgatgcttcccttgctttatttttcaatccagatctcattctgcagtcctctaggaagtaaggagatcttttcttttcttgaaaaaaaaaaaagttttatttctttctctcactctctttcttatttattttgtaggaatccaaggtagcatctttgtgacactgtctaaggaagaatttttaaagtgcaaaaataaatccagcattagggtgcctgattaagcaatagttccttggattgcaaaattcttttgaaaaaatatgccatggtatttttattgagtttacaagctgaaagccatttaaaattccaaggagaacaacaaaaagaataaaaaaacacacatgtggtgttactaaaaaaaggcaccaaagatgtgtactaggcatgatttttcctgggaaaaattatgaagcagatgaaatctgtgtttatcatttttccatgccttgttttgagtcccatttccatctctgctctactcgtcaccagctgtcatactgtatcattcctctttgggattccttgctgtggtattctacggtatatgtttagactttcccttttcttaattctgttttttccctctctacaaactcttaggattctgctagagaactatgctagttgattttttaaatatacatactaaagtatgaataactgttggtggttttttaacctgaaaacaaatttgacaagaatgatcaggaagataatcacactttcttggcatttgttacttggcttctctgtgggtccaggcctgacactaatggaagagggatgagtcctctaacaaagatgaaaattattaagaactctagaaaggaaaaatatggggccaaagctggttaacccatgggtaagcgaggcttagaaaataaagaaatttctttaatggctgggtgtagcggctcatgcctgtaatcccagcactttgggaggccaaagtagggggatcacttgagttcaggagtttgagaacagcctggccaacatggtgaaaccccatttctactaaaaatacagaaattaggtgggcatggtggtgggtgcctgtactcccagctacttgggaggctgaggcaggagaatcacttgaacccgggaggcagaggttgcagtgagccaagatcgtgccactgcacttctgggtgagagtgagactctgcctaaaagaaaagattctttattaataatttctttagtgattattctttagtaaataaataaagcagtgccatctgctatattatcttgtacaaatctcttagctttttctaagttttttcccagttgtaaaatagggaataataacatctataggttattgggaggattctatgacagtatataagtgaaattatattgtttaatgtttggactaatgatgtttaagataattttgggagctgggcatggaggcttacacatgtaatcccagcactttggaaggccgagtccggtggatcacttgaggtcaggagtttgagaccagcctgacccacatggtaaaaccccgtctctactaaaaatataaaaattagcctggcatggtggtgcgtgcctgtagtcccagctactctggaggcagaggtaacagaatctcttgaacccgggaggtggaggttgcagtgagcctagatcatgccattgcactccagcctgggtgacagagtgagactctatctcataaataaataaataaataagataagtttttgggattcctaagtactttgtatttgctgtgctggaacacccatcacagttctccaggtctgagggaaggacagagaagaaatgggcacttaccactgctgtaaaactgaaaagaaaaaagttgccatttgccagtgctcaaaaataatcttatacttctggtttatcttcattcttcaaatgttactttgaaatatgctattatttgggggtagatgtgttataatattattttaattgctgctaaaggaattatagtcattgataaaaatgaatggtaagacagctagtttgtgtttcatttaagatatttgttgttttcttccagatagagctttcctcttagtcctgcaaacctaattgagctgattggggcagggcccattcaatgatctgcaggttagaaaccagaggaaaagagaaggacagaaaaaaaagctgaaaattataaacactgtaaaccactactttgtcttccagcctgcctgcatgatcagtttactcataattagttcctcagtctttactgagccccaatgtggaaatactggagcacagaagcactgtggtttatgggaaggagtaaagacagagcatctggttttgaagagctatgttttctcttggggaagagacccacatgcttaaatgctgtaatctttaaaaggcagaataaaactgccagagtacagaagaaagagaaaccattttctggtagggtcaaaagggatgactcccaagataggacaatacctccaaaggcatgaacatttacagaagtaaagacaataactttgaggagaacccacgtttaaagatatgagacaagaaaaagggaacagtaaaatgaaacaatagaatgaccagataggctgtatctggaagactataataaattaagcatttaagcaaaaaagatgctattttctctctctcagtctgtctctctctctctttttgagatggagtctcactctgtctcccaggctggagtgtagtgacacgatcttggctcactgtaacctctgcctcctgggttcaagcgattctcctgcctcagcctcctgagtagctgggattacaagcacgcaccatggtgcccagctaatttttgtatttttggtggagaaggggtttcaccatgttggccaggctggtctctaactcctgacctcaggtgatccacccacttcagcttcccaaagtgctgggattacaggcctggccattactcttattatttattcacatcttccacttgtcttgaggtgagagaatttgttcaaaatgatgtttagaacttcctttgaagtaataacaaaattcaggatcagatctgatagctcatattatgcttgcaaagaatttcttgtttcatcctggagctgcgatattactctacaacaataatgtcagttataggaataaagatccaaaatatttaatcaaactcagtttgagacaacataaaacattcctttataaatgctttatgacagaagttacatggcttatggaaaaagtatctttcctctttggatcttaggagggctgataatcagtccttgacttttccttctctctagccacagtttcacatatacaattatccactggatatataaggaggtcagagtgtgtgtaggtttgtgcatgtgtacacatacaggcagtgaattcacttagtatttgaaagtgaacccagcagtacttaccggaaggcctgtttggcctgatctacccaagggtcctataattcctggtaagcccatctctcctttttctccatcctctccaggaagtccccttcctcctggtactccctgtaatgcaataaaaaagttttctataaaggaatacagtgaaataattatgccaataataaacaggtttttgtcacacaaaaacaatgatgtctaatattttaaagattttacaaaacatctattttatatataatcttaaaagtataatttacctttaacccatcttttccctggagaccttcttctccaggagctcctggttcaccctattttgtagcagaaagagtatgattgagtttttttttgctatatcatttatcttattttatttttagcccatagtatatatggaaaatagcaaatttgtgttcacttatttctactactttatttctaaagaggatttgacagtaaaatgagaatgatttaatttgccttgaatagctctgaagatgatttcatgattcagagtgtcataaattcaaatataagatgattccagaatattaataaattttagataattaaagtaatatatatccatttggtagctctagaattttacatagctagacttgtgtttctgagttcaagaaatgtaaatactgcatctcataaagttatagtgctttgctatattgtatttacatgggttaataaaacttgattcagttatgaccactctaccagatttttagagtttccatattttctccctttaagtagagaggtaaagattaaggctctgcaacgtacaaattcaggaaatacagagaacaccacaaagatactccttgagaagagcaactccaagacacataattgtcagattcaccaaagttgaaaagaaggaaaaaatgttaagggcagccagagagaaaggtcgggttaaccacaaaggaaagcccatcagactaacagcggatctcttggcagaaactctagaagccagaagagagtgggggccaacattcaacattcctaaagaaaagaattttcaacccagaatttcatattcagccaaactaagcttcataagtgaaggagaaataaaatcctttaaggacaaacaaatgctgagagattttgtcaccaccaggcctgccctacaagagctcctgaaggaagcactaaacacggaaaggaacaaccaggaccagccactgcaaaaacatgccaaattgtaaagaccatcgatgctaggaagaaactgcatcaactaatgagcaaaacaaccagctaacatcataatgacaggatcatattcacacacaacgatattaaccttagatgtaaatgggctaaatgctccaactaaaagacacagactggcaaactggataaagagtcaagacccatcagtgtgctgtattcaggaaacccatctcatgtgcagagacacacgatggctcaaaataaagggatggaggaagatctaccaagcaaatggaaaacaaaaaaaggcaggggttgcaatcctagtcactgataaaaagactttaaaccaacaaagatcaaaagagacaaagagggccattacataatggtaaaaggatcaattcaacaagaagagctaactatcctaaatatacatgcacccaatacaggagcacccagattcataaagcaagtcctcagagacctacaaagagacttagactcccacacaataataatgggagactttaacaccccattgtcaacattagacagatcaatgagacagaaagttaacaaggatatccaggaattgaactcagctctgcaccaagcagacctaatagacatctacagaactttccaccccaaatcaacagaatatacattcttctcagcaccatatcacacttattccaaaattgaccacatagttggaagtaaagcactcctcagcaagtgtaaaagaacagaaattataacaaactgtctctcagaccacagtgcaatcaaactagaactcaggattaagaaactcactcaacactgctcaaccacatggaaactgaacaacctgctcctgaatgactactgggtacataacgaaatgaaggcagaaataaagatgttctttgaaaccaatgagaacaaagacacaacacaccagaatctctgggacacatttaaagcagtatgtagagggaaagttatagcactaaatgctcacaagagaaagcaggaaagatctaaaattaacaccctaacatcacaattaaaagaactagaaaagcaagagcaaacacattcaaaagcacaccgaaggcaagaaacaactaagatcagagcagaactgaaggagatagagacagaaaaaacccttcaaaaaatcaatgaatccaagagctggtgttttgaaaagatcaacaaaattgatagaccgctagcaatactaataaagaagaaaagagagaagaatcaaatagatgcaataaaaaatgataaaggggttatcaccaccgatcccacagaaatacaaactaccatcagagaatactacaaacacccctatgcatataaactagaaaatctagaagaaattgataaattcctggacacacacaccctcccaagactaagccaggaagaagttgaatccctgaatagaccaataataggctctaaattgagtcaataattaatagcctaccaaccaaaaaaagtccaggaccagatggattcacagccgaattctaccagaggtgcaaggaggagctggtaccattccttctgaaactattccaatcaacagaaaaagaggaatcctccctaactctttttatgaggccagcatcatcctgataccaaagcctggcagagacacaacaaaaaaagagaattttagaccaatatccctgatgaacttcagtggaaaaatccttgataaaatactagcaaattaaatccagcagcacatcaaaaagcttatccaccatgatcaagtgggcttcatccctgggatgcaaggctggttcaacatatgcgaatcaataaatgtaatctagcatataaacagaaccaaagataaaaaccacatgattatatcaacagatgcagaaaaggcctttgacaaaattcaacagcccttcatgctaaaaactctccattaattaggtattgatgggacatatctcaaaataataagagctatttatgacaaacccacagccaatatcatactgaatgggcaaaaaactggaagcattccctttgaaaactggcacaagacagggatgccctctctcaccactcctgttcaacatggtgttggaagttctggccagggcaatcaggcaggagaaagaaataaagggtattcaattaggaaaagaggaagtcaaattgtccctgtttgcagatgacatgattgtatatttagaaaaccccatcgtttcagccccaaatctccttaagctgataagcaacttcagcaaagtatcaggatacaaaatcaatgtgcaaaaatcacaagcattcttatacaccaataacagacaaacagccaaatcatgagtgaactcccattcacaattgcttcaaagagaataaaatacctaggaatccagcttacaagggatgtgaaggacctcttcaaggagaactacaaaccactgctcaacgaaataaaagaggacacaaacaaatggaagaacattccatgctcatggataggaagaatcaatattgtcaaaatggccatattgcccaaggtagtttatagattcaataccatccccatcaagctaccaatgactttcttcacagaattggaaaaaactactttaaagttcatatggaaacaaaaaagagcctgcattaccaagacaatcctaagccaaaagaacaaagctggaggcatcacactacctgacttcaaactataccagaaggctactgtaaccaaaacagctggtaccaaaacagagatatataccaatggaacagaacagagccctcagaaataacaccacatctctacaaccatctgatctttgacaaacctgacaaaaacaagaaatagggaaaggattccctatttagtaaatggtgttaagaaaactggctagccatatgtagaaagctgaaaacggatccctttcttacaccttatacaaaaattaattcaagatggattaaagacttaaatgttacacttaaaaccataaaaaccctagaagaaaacctaggcattaccattcaggacataggcatgggcaaggacttcatgtctaaaacacaaaaagcaatggcaacaaaagccaaaattgacaaatgggatctaattaaactaaagagcttctgcacagaaaaagaaactaccatcagagtgaacaggcaacctacagaatgggagaaaatttttgcaatctacccatctttcaaagggctaatatccagaatctacaaagaactcaaacaaacttacaagaaaaaaacaagcccatcaacaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaaatgctggagaggaggatgtgtagaaataggaacacttttacactgttggtgggactgtaaactagttcaaccattgtggaagacagtgtggcgattcctcaaggatctagaattagaaataccatttgacccagcaatcccattactgggtgtatacccaaaggattataaatcatgctgctataaagacacatgcacatgtatgtttattgtggcactattcactatagcaaagacttggaaccaacccaaatgtccatcaatgatagactggattaagaaaatgtggcacatatacaccatggaatactatgcagccataaaaaaggatgagttcatgttctttgttgggacatggatgaagctggaaaccatcattctcagcaaattatcacaaggagaaaataccaaacactgcatgttctcacttataggtgggaaataaacaatgagaacacttggacacaggaaggggaacatcacacactgtcgtggggtaggggagggggaagggatagcattaggagatatatctaatgtaaatgagaagttaatgggtgcagcacaccaacatggcacatgtatacatatgtaacaaacctgcacgttgtgcacatgtaccctagaacttaaaatacataaaaaaaaaagactaaggctccggtacattaattagttgtcttttagatatggaacttgcagaaatgtagagccatactttatgaagctattaaagtaggactggctctcttgatactaaaattatttaaaagtaaattaattagtgcatatttatagttgctccatctttcccattcaccccaccccacccaaaaaagagaaagtaaaaaggaagaagccagatgcaaaatatatctccctactttgccttttagtgaataaatgtctgttaaaattatcttgggccctattatcttaggaaaaaactccttaccacagctcaaaataaaggctgtctatattagcataacgtctcaaagctatctaattgcaacaatttacaattatgtccttgcatcttgttaactttgcatgatcataggtttggtttttttttagagcaagttaaatctataaattagatttcaatcttgttaggtcaggaactattctgagagttgttcactggtatttgtgaatttcttcttaatgctaacattagtgacaatcacagtgactccacatttttggtaagggttctgcaaagtatacctgattttgagaaaaggacatatgaggttaagactgtaaatactactaaattagaatagggacaaggtttgggatgcagcttttgaaagtatgaaatgaaaccaaacattttctataatgtatcagaaaggtttattatccaattttttgagtgtttcgaataataagttttgagcctctgaaagaagtgggttagtgtattaaaagagtttcaagggggcactcacccgtaaacctggttccccagttcctccaacactgccagcagttccaacatctccctgaagaaacaaagggaaagattaaactcttttctactaagactgcatggctaattatggagggcatgccatacggcacagttccccaacgcctgggccgtagagggtacctgtccaaggcctgttaggaaatgggctgcaaaacagcaggtgagcagctggtgagccagcattactgtctgagctccacctcctgtcagatcagtggcagcattagattctcatagaaacacgaaccctattgtcaactgtgcattcgagggatctgggttgctcagtccttatgagaatctaatgcttgatgatccgaggtaggacagtttcatcctgaaaccatcccctgctctgcttccatctgtggaaaaactgtcttccatgaaacttgtccctggtgccagccaaataggttggggactgctgtcataaggaataggagttccaaaacatttcctgtttttatctgggggcttccacctgctttcaagttagcaaatataggggattcaatggtagcaaatgtagggggttcaatggtgaaagtttagagattctcctttattttttagaaggttacctttgcacctggttcaccttgcagaccagactctccctcagtgcctggaggtccctacaagagaataatttaacacattacaaaggcaatagcaatctcatgagaagatggtggtaacactgaactcaagggtgagatacctgtgtccaaaagggcataattgctgtccctttataaacttcatagcataagagcagattctttctgacaccctttaattgtttaaatgtcaagacaacttcgtctaaaattaggacttttaagatccatttcttctaatcctttctctcatcctttaaacctcatctaaagggatttgttcttcctttccctttctgtagtgccttcaggaatctacttacttaaaaaattcacttttccttattggtttcataaaaatatcatgcaaataagagataaatttattcacattataaaagacacacacacacacacacacacacacacacacacacacacacacacacacagagcttcttttccagccttctttcatggtgggtccatttttgttgggaagctttcagttttctttactttgagaacatagaagttcttgcaacctctggctatttccaggcctaaagttcctactattgcttgatgttacaactatttttgtctccaagagatatttaccttatttataaacatgctatgtgtgcccctcccttccctttagggaagagaagagttttattggggacacgggtgaacaggtctgcagaaattaaatcatgtaaaccattacttatcatgttaagaaattggcattttatcctaaaggccatgagagctcttgaaacatttaaaggaaacgaatgatataagaatgataaaccggcaacaagtagaagatggaattataggagttggaggagacatggcatgagagtgtaggggctattacactggcaatagggataaaaaggaaagggtagatttaagagagaatgggcaggggcaggcctattcaaaaggaaatggtcactgatttgagaggattaggtagaagaaggagtctaggatgactcttagttttgggttattgggtataagggatatctttcattgagatgggaattaaacagaggaagaacagtgggacagtaatggatttggtttagatattttgaattgtagatgtctgtgggatatctaggtggatgtttaaaaagataacaggaaatcaataattggatctgaggagagaggtataaaatacagctaccaagttgagagctatcagagtaatattggtacttaaagtcactgtgataatatgatcactaagccaaggaagtaaaagggcaacttcaggtcaagactgagaaaggctaatgagaaggtgaagtgacaacaggagagagcagtttcacagcagccaaggaaggaaagaatttgatttatttagtgctaaagttacaaacaatggaaataaaataattggatatttataacaaatttggcttataattccaaaatatatcccaaattgggtaatgtctcagtattcttctatacagggcatataatatcttaggatgaaaggttatcaagtcaactttaaatcagtgaagggaaagctctatctactttttgttctgtcatttcaatgaggtaattattagagtagaactttatatgtataaaattagacatataataatcatctctgcttttaatggaattttagtttttttctgaatatgaaacaatactatagaattattcctcatagtatatatttaattattaattttaccttagagtcttacaaaaagtagaatatttatgaagaagaactagccacaaaaaatttacctccatgcccatttctccaggaggtccaacatcaccttgcagtcctcgcagtccctatattaaaataaaatttaagatatgagaataaaagtttactctatgtcagtaaatgtattcatctggatatgggttttataatataacacataacacatgattatgtaaatacataatacatttatcagcatattactttactctgtataaacaaaattatatctttaattgattcatgtatgtgtgtgtgtttttgtttttgagactgagtttcactctggttgcccaggctgaagtgcaatggtgcagtctccactcactgcaacctccgcctcccaggttcaagcgattctcctccctctgcctcccaagtagctgggattacaggcaattgccaccacgcatggctaattttcatatttgtagtagagatgggatttcactatgttgaccaggctggtcatgaactcctgacctcaggtgatccacctgcctcagcctcccaaagtgccgggattacaggcatgagccactgcgcccagcttcatgtgtgtttttaaaataaatttactaagctatgcttatattaaaaagaaaagagtggcattcattcttttattctttaatgcactcattcattcaacatttattaagcacctcataagtatcatatattgtgctaagcattttgacaaggtatcttatctaatgtatgtgatagtcattcatctacttaaaattcctagcaaatatgtgacaaacaaatttgcatcttaaagaagtaaatatatgatctttttttttactgactgtacagttttacccctcaagagtgtcatatagttggaatcatacagcatgtaaccttttcatactgacttctttaacttagcagtatgcatttaaagttcctttatacatttttgtggcttgatagctcatttatttttaatgctgaataatattccattgtatggatataccacagtttgtttatccatttattcattggacattgttttagttcactcaggattctataacaaaatagtataaattaatagcttataaaccacacaaatttatttcccacagttctggaggctggaaagtccaagatcaaggtgctggcagattcagtgtctggtgaaggcccacttgctgcttcatagatggtgccttctagttgtgtcctcacatgttagaagaaatgagctagctctctcgtgcatcttttacaaagacactactcccaatcatgagggcacagcacctcaaagatcctgccctataataccattaccttgggaattgggatttcaacatatgaattttggggaaacacggtccaattatagcagacatattggttcatattggttgcttcaaattttttgcacctataaataaagctgctataaacattcttgtacaggtttttgtgtggacataagttttcaactcatttgggtaaacactaaggattgtgatcactggatcatatgttaagagtatgcctagcttcttaaaaaactgccatactgtcttccaaattggctgtaccattttgcattctcaccagcaatgaatgagagctcctgttgctccacatccttgccaacctgtggcattatcaaagttttagatttcagccattctaacagatgtatagtggtatgtcattattgttttaatttgtaatttactaatgacatatgatgttgagcatatttttacattcttctatgccatttctatatcttctttggtgtggtgtctgttcagatttttgccaacattttaactggtttttaaagaaaattgttgagttttaatttttttttctatattttggatacaagtcttttatcagatatatgttttgaaaatattttctcccagtctgtggactgtctcttcattctcttaacagtgttttttcaaggcagatttaaaaagatgttaatgaagtccaacttaccagttttttctttcatgggttgtgcttttggtgatatagctaaaaactcatcaacaaacctcaggtcacatagattttctctatgtttatattttaggagttttatggctttgttttttacatttaagtctatgattcattttgagggtgtgtgtgtgtgtgtgtgtgtgtgtgtgtgtaaggtgtaagatctgcatctagattcacgttttgcatgtggatatctatttgttccagcataatttgttgaaaagactatccattgtattgcctttgctcctttgtcacagatcacttgattttatttgtgactatatgttgtgtatattgtgtagaacaaagagtataactgttctatttctgggcttaccactctgttccaatgatctacagtcgacacttaaaacaacataagggttacagtgccaacctcctgcagagttaaaaatctgagtacaacttttgactcctccaaaatgtaaccacttatagcctactgttgactggatgccttactaataacataagcagctgtttaacacatattttatatgttatatgtattgtatactgtattttaaagtaagctagaataaagaatactgtattcttaagtggaagtagagcatcatcaagatcttcatcctcattgtctccatgctgagtaggctgaggaggtggaagaagggaaggggttgttctcactgtctcaggggtagcggaggtgaaagaaaatccacaaataagaggacctttgcagttcaaacccgtgttgttcaagggtcaatcgtacttgtctattcttttgccaatatcacactgtcttgattactgtagttttacagtaaatcttgaagtcagtgtcagttctccaagtttgttcttcaatattgtattggctattctgggtcttttgcctttccataggaacttcagaatctgttaatatctacaatgtaacttgcttggattttgattagaattgaattgacttgatagatccatttgtgaagaactaatatctcaacaatattgagtctttctacccataaccatgaaatatccttccatttatgtagatctttaatttctttgataaaagtttacctcatatagatcttgtatatattttgttagagttacaactatttctttctctcttttttggtgctaatgtaaatagtattgtgtttttcattttaaattccaattgctcattgctgttaatatagaaaagcaattgacttttgtatattaacttataccctgttatgctacaatctcattataactgcttattagtttcgggagtttaaaaaatcagttcttgaagattttttacacagacagccatgccatatacaaagaaagacagttttatttcttctttccaaatttgtatactttttcttttcttttcttattgcactagctaggacttccagaactatgctgaataggagtcaaaatttaacaaaggaggaacatgttttccttattcccttgttcttaaaagaaaagtatctagttttctcaccagtaagtataatgttggctataaggttttttaaaaaatatgtttttcaaaaagctgaggaagtgcccctttattccaagtttgagagttttttttttatcttgaattgttgttggattttgtcaaattatttttctgcatcttttcatattacattttcatttagcttattgaggtgatggattacattaattgacattctactgttaaaccagccttgtatacctggaaaaaattccactgggttatgatgcataattctgtttatacattgtttgattcaatttgctaatattttgttgaggattttacatctatgttcatgaatgatattggtctatagttttcttgtgatgtgtttgtctggttttgtttttaaggtaatgctcacataatggcctcatgtgtgtggcctcacataattaggaaatattctattgtttctattttctggaacagcttgtacataattggtatcatatgttctttaaatgtttagttgaattcaccaatgagataacctggaaccagtactttctgttttagaaggttattagtgattgattctatttctttatcaatacaggttgaggaagatattgatggatatcaaatcaaatcaaatcaaatcaaatcaaacctattcaggttatccctttctgtttatatgagttttggtaaaatacgtcttttaaggaattggtctatttcatttaagttatcaaatttgtggaaatattgggaggccgaggcgggccgatcacgaggtcaggagtttgagaccagcctgaccaacctggtgaaaccccatttctactaaaaatacaaaaaaaaaaaaattagccaggtgtggtggtacgcacctgtaatcccagctacccaggaggctgaggcaggagaatcacttgaacccaggaggtggaggttgcagtgagctgagatcacgccactgcattccagcctgggtgacagaacgagactctgtctcaaaacagaaaaaaaaatttgtgaaaatagaattgctcataatatccatttattgtcattttaatgttaatgagatcagtagtgatggcctctctttcacttctgatattagtaatttgtattttctcctttttttccccttggttagcctggcctgaggttgattaattttggttgcattgatgttctctattgttttcctgttttcaatttcactgatttctgctgatttttattacttattttcttctgcttactttgtatttaatttgcttttcttttatagtttcctaggatggaagcttagattactaatcttaagtatttcttctttcctcttattcagtgctataaatttccctctaggcactgcatcccacgaattttgacaaactatattttcatttagttcaaaatatttttaaattattcctgaaactccttctttgaccaataagttattaaaagtgtattatttaatctccaaatgttttgggattttccagccattttctgttactgtggtgtgagagcaaacattgtatgatgtctagtcttttaaatttgttgttggccgggcgcagtggctcacgcttgtaatcccagcactttgggaggctgaggcgggcggttcacgaggtcaggagatcgagaccacggtgaaacccgtctctactaaaaatacaaaaaattagccgggcatggtggcgggcgcctgtagtcccagctacttggagaggctgaggaaggagaatggcgcgaacccgggaggcggagcttgcagtgagccgagatcggccactgcactccagcctgggcgacagagcaagactccgtctcaaaaaacaaaaaacaaaaaacaaaaaacacacgaataaaaaaatttgttaaggtgttttatggcccagaatttggtctatcttggtgagtgttccatgtcagtttgtgaagcatgtgcattctactgttgttggataacatattttataaatgtaaattagatctagttgacttacggtactaactctctcttgactaattttctgcctgctgggtctctcaattactgatagaggggtgttattgtctccaactataataatagagtcatctatttttccttgaaaattatctcagcatttgcttcatgtattttgatgctccgtcgtcaggtgcattaagtactgttatcctagcttggagaaatgaccctgctatcattgcaccatgtctctctttaccctgacaattttccttgttctgaagtctgctttctctgaaatataaatatttccagctttcctttgaatagcgttagcatggtatactttccttcatatttcacatggatttcttgaagacaacatacaattgggttttgctttcctattcactttggcaatctcttatttcttaagtggtatacttaaaccattgacatttaagtgactatgatatcattgagttagtatatatcaactgtggactgcgttagttttcatttgttgtctttattctttattgcttcttcttctttcgtcttcttcttcttctttttaatgtttttggcttctcattttattttattttaatttttatgtctatttcttttttgagatagagtctcactctgtcatccaggctggagtgtagtggcatgatctcggtgcactgcaaactctgcctcctgggttcaagagattctcccacttcagccccctgagtagctgggactacaggagagtcccaccatgtccaactaatttttgcgttttttggtagagatggggttttaccatgttgtccaggctggtctcaaactcctgaccacaagcaatctacctgcctcggcctcctaaagtgctaggattataggcatgagccactgtgcccagtctggcctctcattttaattaagcgttttatatgatttcattttctttcctggtttagcatacaaactatactacttttaaaactttttaaagtggccactctagagtttgcaatacatatttacaattaacccaagtccattttctttctttttttaaaaaccctacagcacgtggtattcctaggccatctccaatccctgtactaaccagtcctgaccctgtttagcatccaagatcagatgagattgagaacattcagggtgctatggccattgatcaagtccattttcaaataacactataccacttcatgagtagtgccaatactttataacaattcctccctcttgttccttataacatttgacttatccatgagatacaataccgaatacactgttgctattattattttgtacaaattgtctgttagatcaattaagaattataaaaatattttattttacctttatttattccttcgccaacactcctttcctagatgagtttcttacctatgccacttttcttctctctgaagaacttcttttaacatttcttgctggtctgctagtgacaaattctttaaatttttgtttgagaaagactttatttctctttcactttgaaattcccagtttcataattccaaaatgtctgctatccctgagtctgtttctgcttgtctctgtagactgtttttgccttttaccttgccttataattttttttgaaagccagacatgatgtaaatgtaaatgaaaccaaggtgaataggcctttaatgtgatatttgatattatctggctgggggttaggctgtgtttactggttgttgtagctatggtgtctcaggctaaaatgtcctctaatgtcattgttttttactcccctgttttatttagcctttctgagggactctttaaatagggtttgtggcacagttcctttagctataatctgttattgcacaggaaccccactgatttgattgtaaggtatgagtgtaggaagggcattctatagttctacaattaggtctcagtcttttagtgagtctgaattggatattacccttcttccacatcaaaggccagagggggctggagtggaatatttctcttcctccagctgaaggctagagggaggtgaaattaggttttcctttcccaaaggtcagttagtctttggtaaaacaccagtttattctctgataaataatttccctggagggcaagaactgttaaggagatcagagaattctaggtgtttttcaaaatgcttactatccctctccctctgctggaagtcagagggaatttttctctatctttaaagtaagaacctgttagggctctgggaggaagtaaaactcaggaacatgtaggggcctcccaaagactgggccctctctgagttttttaacactcaagctggtctacactgagtctccagtaatttgctaattatagtttaaagtgtccctactgtcccggtgtgggctatgtagttgcctgtctgtctctccattttgggggcagtagtttgtcttgtaaccttaattctctgacagatctaagaagagttgttgattttcagtatgtccatctttttttcttgttttgaggatgggagtgatgacttccaaattccttacatttcataccagaaaacacatttatttatttacttatttagaggcagagtcttgttccgtcacccaggctggagtgcagtggcgcgatctcggctcactgcaacctccgcctcccaggttcaagtaattctcctacctcaggttcctgagcagctgggattacaggcacccaccaccatggctggctaatttttgtgtgtatatatatatatatatatattttttttttaagtagaaactaaatgttggccaggctgatctcaaactcctgacctcaggtgatccacctgctttggcctcccaaagtgctgggtttacaggtgtgagccaccgtgcccaactcagaaaacactttactattgtcaacctaaatgacaaagagaaagaggctctctaaaataaataacgaatttattttggaatagagcattgcaatgggaatatgcatgccatagtaagctatgcacatattcagggagataaaggaaggtaatggtttttaaaggaaaaatgaggattatataattgttttgaaatgattatccttggctaaaaatatcaacaacaatggtgacaccagtccaaggctggacaggctgttgctgggcagatgtcttttcagaagtattttttgtatatgggtgcaaatgtcctttgggcaaggttgtgatttttgcaattttttgtgatagtttttgttatcaggcatctaagaatgagaactctgtctttatggccttcagctctatttgtcaggtttttcttttattttcttaacatcagtgactccattttgattctgacaactttcacattatgatttttaaatcttttttaggggggagactggattcagctagaagccaaattgtgttccacacacaataactttttttttttttgagatggaatctcactctatcacccaggttggagtgcagttgtgcgatcttggcttgcctcctgggttaaagcaattctgcctcagcctctcgagtagctgggactacaggtgtgcaccaccacatctggctaatcttttgtatttttagtagaggtggggtttcactatattggtcagactggtcttgaactcctgacctcaagtgatccatctgcctcggcctcccaaagtgctgggattacaggcgtgagccaccgtgcttggcccccatgcgatgatttttaaagaatcaaaaatggttggctggatgtggtggctcacacctgtaatcccagcactttgggaggcagaggcgggtggatcacaaggtcaggagatcaagaccatcctggctaacacggtgaaatcctgtctctactaaaaatacaaaaaattattggggcgtggtggcatgcacctgtagtcccagctactcgggaggctgaggtaggagaatcgcttgaacctgggaggcggaggttgcagtgagccaagattgcaccactgtactctagcctgggcgacagagcgagactctgtcttaaaaaagaaaaaaaaaatggttgctaaattttagactacttgcttttgtatttctcattatatctgtgatatattaatagatttcttaataacaaacttttccttgattgtaattcttccttttacttcattaaggtggataattctttatatacatggttaaattttacttaattttttgtttagatttttacaattacatttgtaagtgaaattcatctgccactttattttggctgctctctttgtctgactgagatgctgatatagagtactcttatcttttgtttccgagactgttgccactttatctttacaagtgatctaatgaggaactgagtgaagttttattatacacttttagttaacttgagaatcctgttaactattttttgaggtaagtggaaatgacttctggtatctaagaaagagtagctagaaaataatattttaaaatttacaaggggatattataaagcaagcttatgaagagttaattttagagtacagcattccccttgttccctctttaaagtcagttttcaataattaacagatattaactatatttatttaggtcaggagattttttttcaacttgtcttctgaaacggaagaataaatgaacaaaataataaaagagagaatggacaaatatcaccattctcctcttattgaaggcgattgggtacagttgtgcaggttgaacactacataaaccaagggacattatttgttacaaggtttgcattgattagacattttctttctgtacgtgtgtgattaaaatctacatcaggggtcagcaaactttttttttttttcaagggcaagacagtaagtattttaggcttgtgggtcatgtggtctctgtcaaaacttttaaactttgctgttatagtatgaaagcagccatccatacataagggaatcgttgtggctgtgtttcaataaaatttgatttacagaagtataactggactgagggctgtagtttacctatcctactttatgcctacgtacttctaaggggatctaatattatcatgaagattttaagatgggttatgtttatggctgaaactcctaacttacatgtctgattttcctcttattctctcagtttcttgtgcagtttcaaccttttctgccagcgttttgtaaatgttgtagttctttaagcctcagccttagatctttttcttttctcacttctatactctttccataggcaatgaatccaacattttttaacttcagtgtattcctctactctgaagccaactgccaacttcatgtttctcaaagacacctgaaattcaacagttaaactgaatttataatcttccattctcaaacctacttttccgtgtttttttttgtttcagtgaatagtatcatcaactctttaatacaataagccagaaatttaagaattatacttcacatacagagtctttattacctattggttttatctccttttgaattagtctgtccacttcttttccctgctcataaaaaaggtcctgccattttttatctggattattgcaacagccagccattcttggctccctccattttgtaatttgactgatgtttacaaaatagatatcagataataaactaaataatctgataataaagctagcccgagccctttaataacatcctttgttctaaggataaaaattaaaaatgttggcaatagccctcataaatctatgagtgttttgtcacctgcctcatttctatccctatctggcacttacttatatataccagacattataccaggaaaggggattacaaagataaaagaaatggtctctgatttcaagcagtgtacagactttttaggggatatacttaagtaaataatgctaaagagagttgcattattttaggtcagataaatatcagaattgaaatggcaggttaagatatacataatagggagaaaaccaagaaggatttagcttaaaaaatcaacaacatatctaagattctttatttggaaagaactataaatactgtcaaatcttcacttattgtttgagagcttatatcacagattaagtatataaatgaggaaaaagctaaggtaagaatagctcttttagtgttagaattttccatttgctactaactaaatgaattatacaaaagccacctgtaaacctttgtgtcaaccgataataaaatcaatgcagttgtttgaaagactatattgtattgtacatcttagaagcacattatagcacattacatctgacactattaaccagaagaatgacttcattggcaaaaaagaataaattgtaagaaagtaggtgtgacaggtctttccttttcacaacgtaccgtccatggaaactccataattgaatcatatttatgaaactatttcataatgatttcataagtttttgtattgatgcaagcttttgtactgttgatgtaactgcatttctgtcatgtttgcacattttggcccatcagatgtaaaatttggcttctctctgtatggtcttctaattatagaaattgcctcataaatgtgattgtgcgtgtgtggcaacataataattataagaacagcaagccattcagaaagagaatttctgagattcaataaaacagagttttatttgttgaaaatagaaatatgctcagatttaacagctccagaaaaacagcaccatatttgactatatgcaaccagaaaggcactataaactattatttttcattctatgtgattagtctatggtgtctatgataaatgctgctttctaaaacataccagtcacagcacagcagagcaataatggaaatgtaaatgtattttatgagaaagacacaattagaaaagtataaagataaacttactggctctcctggaagtcctctgtcacctgtacttccaggcaatccctgtaaaccctggacaaataaaggcaatacttgtaggaaaagtggtgtgtgaagatgttttagacactttccttaccttagctttcctatggatccttccacccaacttttctgtctattgctattctttttttttttttgcttttgtggtaagatacacacaacataaaatttactattttaaccatttttaaatgtaaagtttgtggcagtaagtgcattcacaatgttgtgtaaccgttaccagaactttttcatcttcccaaactgaaactctgtacccattaaatactagctccccatcacccctttttttctatttcctggcaaccaccattctattttctgtctccatgaatttgactaccctaagtacctcatattagtgagatcatacaatatctgtctttctgtgactggcttatttcacttagcataatgtcttcaaggttcatccctgttgtagcatgtgtcaaaacttcctgctttttaagattgggtccactgtatgcatattccacattttgtttacctattcatctatcaaagaacatggatcacttccaacttttggctattgtgaataatgcggctattaacatgggtatgcgagtatctgtatgagtcccttttttcaattatttgggtatctacctagaagtggaactgatagatcatatggtaattctctgtttaacttcttgacaaaccaccaaactgttttccacagcagttcccctattttatatttgtaccagtaatgcacaagggttctaattcctccacatccttggccacacaaattttctttttttttttttagaacagcattctaatgtttgtgaaatagtatcccatggtggtttgattttcatttccctaatgactagtgatgttgagtatcttttcatgtgcttactggccatttgtatatcttctttggagaaatgtctattcaagtcctttgctcatttttccatcaggttgtttttttattcttgagttgtaggagttctttatatctacccctatttttatttaatcctcactcctatattgtgacaaataattatccaaaattattttaaatctgaatttctttatagttttaatattcatataaagtttcctttttccaaaaataataatccttgtgatgtgttaataagtatgacttttgcctttaaaccctggcaaggcacaggagtcttggaacctagataactggaaataaccatactggacctgtaacttccttttttccccatctttacactctttgtagtaccataaaagagcatctcagatatgaagtagatagaacactaaaccaaattctgagtcttctctgactcagtcaaagatttattgagcatttactgtgtgcgaggcactgatgaccactgacaatacataacatgttgatccttttgtaaattgcatctttttttcttttttttttttgagacggagtctcattctgtcacccagactagagtgcagcagcatgatcttggctcactgcaacctccacatcctgggttcacgccgttctcctgcctcggcctcccgagtagctgggactacaggcgcccgccaccacgcccggctaattttttttttttttttttttgtatttttggtagagacagagtttcaccgtgttaaccaggatggtatcaatctcctgacctcgtgatccacccgccttggcctcccaaagtgctgggattacaggcgtgagcctctgcgcccggccgtaagttgcatcttctacattattgatctcaggaaagctgataactatacagctaatcacaaataccattttaccttaaaaactaaaaggtataaaaatatgacattaaattagaagtaaagatattcaaagttcttagcaacacactatcttctaagttataatctttaatgctatgttcagtttttctggctagggaaagggaaatatgtaaaattatggactcccatctggttgaggccctgtttcagtcatgtaaatgatatggtgcctatttactccaggatccttaattaagagagaggatcattataaggaatctctctgtgcctagtacaccaactgaaatatacagaaaacttcagaactttaaataatgtctgcccaattttctttgtaaagtatgtttagacataatatcaagcttatcatgtacttttaatgctgttgatactgcataaaagctcttttgcaaagctacgaaataatttaagtggactctgtttttattggggataaagaggaaaagcacaagctggaataaaataaaaattatctttaaggcttttcagaactcccttctctatgacttcaacccagtaactatgataatgatgaccatgaggataataatgactattttggttgttatttattagagcctgtgccaggaacataataaatatcatttgttatacatttattatgactatgaaagatttcctatatcaaagatagagaaactgaagcccagagaagttaagtaatttgtacaaagtcaagactgctagtaagtggcaaaaccaatatatgacttccaatatgattgattccaataaaatataatgatacattatatgcaagggattaattttatatatatataactgtggactacttatcagaaataccagcggccaaaagaaaatggcaagttatctttatagtgctgaatgaaaacaaaaaatcccccaaaagactctgtcaacctaaaatctgatatccggtgaaagtatacttcaaaagtaaaggaaaaataaagacattttataaacaaaaactaagagaaatatgtactagcagactttactacaagaaatataaaggatgttctataggttacaggaaaatgacaccatttggaaacacaaatcttcagaaaggaatgaataacatcagaaatggcaaatatgtgggtaaatgataaacattttttccccattaaacatctctaaagtatgtatttcatttacatcatgaaaatattttatttatattaaagcaaaaatcataactttgcaatgcgtagtttaaaatatatgtagatgtaatacataaaataattatagcataaaaaatattagtaaatggacctatattgttggcaagtttcttacacttgtgttaagtatttacataaaatacttattttgtggcacttcacaataaaagtttgctgtcccttgacctagaataaccatggaaaattatgagaagaaatagagctaaaaatccaacagacagattaaaatagaattctcaaaattattcaatgccaacagaagacattgaacaataacaataaaaaggacacaaagaaaaacagatcattaaatgggagacccaaatctaaccacatcaattacgtatcaataattacattaaattgaaattgaacaaatgctcaaattaaaaggcagaaattgtcagaatgaataaaacacaaggtccaactataagatattcactttaaatatcaagacacagataggttgaaagtaaattaaggaacaagatatgccatgtaagcagcaagcataagaaagctggagaaactttatgtgagtattaatatcagataacatatacttcacaacaaatagtattaccaggagtaaaaagtattaccagagataaacaagaatattttttaacaaaaaaaggatcaattgatcaggaagacataataattataaatgtgaataaacttacaatagaatttaaaaatacataaagaaaaattagaaagaattaaagggagaaatagagaaacacaaaaattatagttgaagaatttttacacccatctcacaaactgatagactatctagataaaaaaaacctcagtaacgtatgagttatgatagtttttatattatttagagaacctaaaatagtgatccaggccttaacaccttaataacacaatggattgtggtctttcttcctgattttcttttgagtcagatgtatgggaggcaagtattgtataggaaacagtgttggtccacggacaaatatacttttactagttatctggattaccagagcactatatgttgccagttttcatttaattcctggcttaaaattatgaaaatttagagatggagagggtcttagagctcttatcccaaccattttttaaaattcattttaaaaataaaaaatatgtatttttagagatgggggtctcactacattgccctagctggtcttgaactcccaggctcaagagatccttctgcctctgcctcccaaagtgctgggattacaggcatgagccaccatgcccaggcctaaccaatttaaacaaagttatatggtttttaggagcatacactagaccaaaggacaatctgacctcgaatttatctttctaatatacagcactgcctgtttgttgatagtgcataaatgactaaaaacgctaagactgtgctgaaggatcaagtgaacctttggggcttgtctggcttttttcagttgacttttcccagcttctccaagatgtcaatccaatcccatcatgtcaatccaatcaaggagaaggagacaatgtaggtatagagctaagtaaacctcaacaactattataaattcatatttaatgtccaaccatgtcatacactaaggtaatttaattcttccaggagtctatgagacatgtttgccaggtaaggttacaaaccagggtaaggttacagaatgattctagtatcttttatttaattgagaaagtcaaacatgaaatatcatgtttatacaggcatacattgatgggctgaaaatgaaggtaaaattctagggaaggtcaacaatgaatgacctatatttttacctttattttcagctcatcaatgaatacaaaatgaataagtaattttatttctctgggtctcattttttttttaaatgagagggatgaacttgacctccaaacttttccactcactgcaatgtatcagcactgtataaagtatatcaaagtagtcataatctatacaaacaccatttatatcaatataatagaaactcaggtgatgaatattaaaactcaagtaatattctttgaggataacgttaatcaataatacaatgccacacacaagttctttcctagacatagtcatttgttttctgtcttaggtctctggtattttaggttggatcactgttaaatacaatgttattgtgggaaacagcgggcagggggcagcagatttcaaaaaggaacaagcaaatgcagtgacatttactacatagacaattattaatactgtagcggctaaaacatttttattctatccttttctgtctcccgagctgcaatctatttatattatctatttttataactttatattatacatatatgtgtatataacaaatcaaaatgtcatcattaaaaattaaaattctgaatgaaagtaaaaatatccatatacttaagcttatgtgctcacatacatgtactatcttacatgtctatgtgtaagtatgcatgtgtgggtaaatctttaacatttttttcctcttacttagtgatgataaccatagaacttgttgcctctcagggaaaaaaatgtataattctggtaagatttttgatggtaggaaaataactagtattataaaatattaacaactcttaagcagtgccatgggaaggcatgaagacacacacagctctatactccaaaggcctaaaaggaattcaagttgagttaaaagaaaactaggcaagaggcctgaaaaaagttagttattatgttagctttattaatgtctcattatatttatatgtcacaccattttattttgaaatgggttttacagtaaaagtaatttatcataactagagtgaagtaaaagtaacagttataaccaccagttatggataggtacaacccaggcccagaatgggtaagcaacttgctcaaataaaacaatgacccaatgattaaaggagaaaaagaacttatattcttttagtccaacatattgaatactaaacaatagttgtattagagaataaagcagataaaggtaatcagctcataatttatacatatatcaaaatatcacattgtatactgcaaatatatataatttttatgtgtcaaaaaatcccccaaacattgtttgagcagcccctttcccccaaaaatgcagataaaaatttttcatagcatgattttttaaattacttactggtttcccttgaaatcctctttctccagggtttccagtcttaccctacatgagaaagaaaattcttgagtcaagtagtcccctccaaaaagattaatcatactaagaaaaacaaaaaagacttaaaatgttcatctttaatgtgaaatgttttattacttacaataagaccatgaggccctctttttccttgatctcctttttcaccctaacaaagtatcaaagccaggtgagttagtaagaatgtgaattatggtcttactatgctagcatatgctagcatacactcacatacaaaaaagacagtaagtatatagttcattattgaaaagaaaacatctctgcctgtgtagtaaaaactttatgcgtttcatacttagacaaagagaaaacttagaaccatacttttgtagggaaatatattgttttttagactagtaggacatatgatctcaataaaatttaactacatatgaaatgagaaaaatcaatgattaccttggcaccttgtataccttgttcccctaagagaccatctggtcctcttgatccctagaggtgaaaaaaatatcctgttgttaatttgaaatgttcctttttttttcttaacagttatgtgtcctcacagatgaacatgttgatgattttttttttttgagacggagtctcactctgtcgcccaggctggagtgcagtggcgcgtctcggctcactgcaagctccgcctcccaggttcacgccattctcctgcctcagcctccccctgagtagctgggactacaggcgctcgccaccacgcctggctaatttttttgtatttttagtacagacggggtttcactgtgttagccaggatggtcttgatctcctgacctcgtgatccacccgcctcggcctcccacagtgctgggattacaggcgtgagccaccacccaccgcgcacggccaagatgttgattttatgccctgacaacagaaaataatacagctgggtatatggctcaacctatctgcatgggagaatcagcccatgtttttaagatttaatgacaaatagtaagtcaaatgagcacaaaaatagctaacacagtagttgaggtggttataatataggtgtgttatttgggtatttcgttcactttataatttactcagcagccagccagaatttgttcttaatcaactctaaattaaaagtggctggatttgtttctctaagcagtctccttaagtttaatatttttaaatggtgctcttctcttcacattattagaaaatgatagcaatgcaggaacagaaaaccaaacaccgcattttctcacttataagtgggagctgaatgatgataacacatggacacatggtgaggaacaacacacactggggcctgtcagggggcctcgggggagggagtgtatcaggaagaatagctaatggatgctgggctttataactaagtgatgggatgatctgtgcagcaaaccaccatgtcacatgtttacctatgtaacaaacctgcacctcctgtacacgtacccctgaacttaaaataaaaattgaagaaaaaaaaagaaataaagtttagctggaataaaaaaaaaaagaaagaaagaaaatgagtgctgactgcattgtacctgctatgcaactgcttgtcaggaattactgggagatggcaggggcacagaaaaggtagagaaaatactactgaaaatattcgtgtaaatttaaaacttctcagtgttcattcaataattagttgcaaaaaagccgttgcaaaagtcattctataagaaaatgacagaatagtcttccattaaattataactttctttggaagatcttaaagtccttgttcagggacttgattcaattctacagactctaactgaatacctgtggaaaaggaattatgttaagtgttacagtgatttataattgagagaaagtttctctactatacaaatatacaaaagacaataatatacagagagataagacatgccaaggaccaaaacaagaattcaaagagggagacaaacttcacatttgtaatgggaaataaagatatttttagcagctggaggtcaagttctcatagacttattcaaaatagaagaaactctacaatgagggatagtatgtgaaaaaaatatagaggcatgaaaacagatactcaaagaataaaaaagtagtttgtttggttaggctattgattacatgttgagaaatattaagatgtaagtgtggaaaagaagactgggacttataaggtgaaggtctgaagttcacttacaaataatttggcagaaaactgatgctaaagatttctatacagaacggtgatacaaatctcccaggacaacatacagatttgaaggagtcctttaggcttcagaatcttctcttgtatcccatctgagataagctttggtttagctttatattattaaaagctatttactataataggactctcttcttgggaactcttagggtaactgcattccttgatcctctgaggcacattcagggatttggacagaacacacacttcatggaggatctgtagctccactgatcctgataaagccatagctccggccctacaatttctaagtctatattcaaggtactccataatctattcccaactttctttctgctctattttccaatgaaggactgaaaaactgaactacagtcttactgtgcaagaccttgaagatcaagttgaggagcatggacttaatttcatagatcagtattttttaacatgtgttattcattcagcagatgtataccgagtgcctactataagccagcattgttttaggtccagaggacatggtagagagaagagacaaatccctgaattcataaacaagcaaataagtacgtaaaactaaattataaaatgaaaatatgtagttaagtataatgaagaaaaacaaagaactagagagtatccaaggtggggaggactatttcagatagggtggcctgaaaagtctctctaaagtgacatgtgggtagacacctaaaagaggtaagattgcaagctatacaaataatttggggaagatcactgtagcagaaaaaacagcaagtgcaaagttctgatgaggggtcatgcttagaatattcaataattgagtagccgaagatgaaaaaagaacagtgttcaaaggatgactcaagttttaagcatgaaggtccctcaggaatttgctctaataatcaccctcaaccctcaagatgatcttgaaattttagccgtctctattgattctttttctctagcaccttcaatgcctaattcttctctttttgctccaaaagaaacacagctaatttttttttgagtaacaaaagaagaaggccaaaagactgtgaaaaggaatgagtggtcaacattctaaaatactataaaaaacaagtaaggtctaaattgaaaatgtgtccactggtaattaattgggcccttaaaactcctttacaacctagaattactatgtatttctttgatattttattactgagtaattggtagaagataacagcatcaatagaaaacaaattagaaatgtaggtttgcttagggtggagagggaggagtagtggaagataaggagtttgactctagatgatcaagcccaatgaagtagatatctccaaggctagtgatagagagttagaaagttagaagtcattctaagtttacgtggtggcagccataagcattaagcttcaaaaggcccctggacacatagttgtatatttagaattttatttaaaaagattgtttggtccaaagatagaaaatacatttcatttcttggataaaatcagattaagtggctgcctagatacacgtagaaaaggctgcatctagctggagtaagtctcataattaattgccagtttcttgtttgggcacagaaatcacctactgccatagctgaactagtccaaatcccactttttaagatgaagaaactgaagtctgtagatgttaggtgagtagcctgactcccacgatgtctaactgtacaaagactgaacgactgtgctttattaagtttataatattttttcaaatgttaaaaagaaatgaggttaatcccgtcagcaagtgaattcagactggaagagaggacctgaaatttagaagtttacaaaatgaatattaaacattcacaagtaaagtgctgattggtattgcaaatcaaggaactccctctaaaattaaggaatacatatagtaataataaccactcattttatgttttacatttaaaaaatacttttactactcaaagcaatctagagattcagtgcaatccctatcaaaataccaatgtcatttttcacagagatagaaaaaaaatcctaagattcatatgtaacacaaaaaagaggctaaatagccaaagtaatcctaagcagaaagaataaagctggaagcaccacactacatgactttaaagtacactactgggctgagtatggtggctcatacctgtaatccaacattttgggaagctgaggagggaggatcacttgagcccaggagttcaagatcagcctgggtaagatggcaagaccctgtctctacaaaaaatttaaaaattagccaggcatggtggaatatgcctgtagaaccagctacttgggaggttgaggcagtgggatcatgtgagcccaggaatttgaggcagcaatgtgatatgatcgcgtcactgcactccagcctgggtgacagagttacaccccatctttaaaagataaaataaaataaaatatactacaaaactatagttaccaaaacagcatggtactagtataaaaacagacacatagacaaatagaacagaaaagagagcccagaaataaatctacacgtttatagccagctgatttttgacaaaggtgccaagagcacacaatggggaatggatggcctcttcaataaatgatgttaggaaaactgtatatccagatgcagaagaattaaacccttatttagcaccatatacaaaaatcaacccaaaatgtattaaagacttaaatatgaagacttggaactataaaacttccagaagaaaaaggggaaaagctccatgacattggtctgggcaataatttttgggttaaaacctcaaaagcacaggaaacaaaaccaaaaatagacaaatgggactatggtaaacaaaaaagcttccatacaacataagaaacaatcaacagtgtgaagagacaacctgttgaatgagagaacatatttgcaaactattcatctgacaaggaactatatatccagaatacacaaggaactcaaacaactcagtagttaaaaaataattctattaaaaattggggaaagaacctgagcagacatttcttaaaagacagacaaatggccaacagacacatgaaaaaatgctcaacatcactaattatcaggaaaatggaaatcaaaaccacaataagatatcatcatatcacaggaagaatgactattattaaaaaaacaaaaatcaatagctattggccaggatgcacagcaaagggaactcttatatgctgttggtgagaatgtgaattattactaattccatagccactatggaaaagagtatggagatttctcataaaactaaaaatggagcctgggtgtggtggctcatgcctgtaatcccagcactttgggaggccaaggcgggtgggatcacctgaggtcaggagtttgagaccagcctggccaacatggtgaaaccccatctctactaaaaatataaaattagctgggcatggtggctgagtagcctgtaatcccagctactcaggagtctgagacaggagaattgcttgaacctgggaggcacaggttgcagtgagccgagatcatgccactgcattccagcctgggcaacagggtgagacaacaggatgagactccgtctcaaaaaaaaaaaaaaaaaaaaaaaaagaactaccatacaatccaggaatcccactactgggtatttatccaaaggaaaataaatcacatatcgaagggacttttgcacctatgtttattgcagcactattcacaatagcaaagatatggaatcaactaagtgtccttcaatggacaaatggataaataaagtgtggtatatgtacacaatggaataatttgtaggaacatggatggaactggaggtcattatattaagtgaaataacccaggcacagaaagacaaatgccacatgttctcacttgaaggaatgaaggacataccatcccaaaatatgtcatgaaaacactggagaaattgtagtttccaaaagggtgagctgatctgtctccttctgcatgcagcaagcaataaagatccctctgggagggctaccttctccataccagtatgagaaaatagcccttatcaccagagtcttacaattgaaggctgcaatggacctgaataaacacactttaatgaagtaactcatatcttccacctgttttacaccccctcgccaatatatctcttagtgacttccctagaaatgtttaccactttagctagattttctttgtcctgtcactttttctcaaatgtatcactctttgtctaagaagtataaaagcatcttgtttggggcacttcagacttcactctcttgtaaagatccccatatacacacaaaactaatataatttgtaacttgtctcttgttaatctgcctggtgtcaatctggtttccagatcctgctgaagagcccactgagggctaaaatgggggctggaggtgatctctggctgccctacacactcatatgtgggagctaaaaaagttcatttcatggaggtagagagtaggacgataaataccaaaggctgggaagggtgtatggatgggagagggagataaagggaggttagtgggtacaaacatgcaatgaaatagaaataagttcttttgttcaataacagagtagggtgactatagttagcaataatttattgtatatttcaaaataaccagaagagtggacttgaaatgttcccagcacatagaaatgataaatgctaaaggtaatgaatgaaataccctaaataccctgacttgcttactattcattctatgcatgtaacaaaatatcacacccaccccataaatacgtacaaatacgtatcaataaaaaagaatgcttccttaaaaaaacccattacttagaaaaatacttttactttattatttcattttataagtcaagacaacacagggaatgaagaaagagaagttctgtgcccacagtgatgataaccacatttagtttaaaaaacaacctgaaggtgtaagtaatgcagttatattaattaaaggtaataaagcctaaagttgctagttaagagtttaaggctggcagaagaactctaggaaagcttggtactctctctgtttaaagcaagagtaagctaattaactgaaagcttagctttatcaacatctttaaatttcacgctgatattggttatagaagttatcccatgggttactgtatatgtctgctttgacttctaagacaaaataagctttacgacaggctgtaagaaagtcaaatagcattataataggcacctaaatttggcatagttatatattaaaataaccgtttaaaaatatctcatggatattctcttagagtaactatgctggctaaagagaaaatctaatatttacattcttaggaaaattaaagttggctgcactgagctgtattagtaagttctcatagcagaaataaaaatttgatagcttagctacataaactaagcatgttttataaaataaatactgcttgaattatgggcaataactaaattcataaatgatcaatttacagaaccactacttcgtatgatgttaacattactcatgtgcctaactaattaggcctagcagtcttttctggctcttgatttacacagctgaaacaaaacgttctattaaacaaaaactaacattatcagtgattttaaggaaaaaaatattttgattctattcttgttataaactatttcaggagaagaaaccacagaggagctctgccttatcatttggagtgcttcaggtattgaatctagctttgaatctaaatgcgaaaattgaggactgcttccccctatatggtaagcatttccttgaaagggacaaatttcagaatttctataggcagatcaattttacttcctccatagaaaaccttaaaacattacatatttttaatagagttattttaatctttccctcccatttaaatcttaagcagcatagtctgaataaaaatgctcagttgtatgcctctatactgcccctctagagaaagagtgcaaacttaaacatgtctcatgatccttgccaattcataatcaagaaaaaagatgaggttaacttcgctctgtgtcatctctcctgtttgggtagctggacacagaggcgtataatggagtaataccaagggatcagttgcctagttctgaagagttccatgtgcagctgatgttgtgctgatttctagtgacccaagaggctaaaccactatctttctggtactgaattagagaatctgctagcttatattgtctacacaagggacatgattttgtatattatactaattagctttggtatgttaaactatttcattttatttaattattcttcagctaaacatgcaggtagaaacaaagcttagagtatgtaggataaataataatactttaaagtttatgccatgtttcttatctaagaatctctgtaagaatgatatttttagtcaatcctgttatctttttcagctatataaaaggcaaggttacttatttcttgagatggtaggacattattatttgtttggggttttcctgtcctttggaaaaatttcaatactgcatggtacttcaaaagccatcagactgtaaaatctatgcagtttagatgtaagagataattaagtctagaatcctccatggtattaatagtgtttgacaggttgcagggaatcagtaaatgttagatagctgtaaggtggatggatgggcaggagagaagcagatagtaagcagactctttggagtagtcctacccttcatgatggtcatatggccatatgttaacagcatcaatcacagtcagaacagcaagagagtataactaccagttccataatgaaaattctctgtgtggtctctgtgcaaatgtacttagggcagagcttccctccaacatgctatgacacgtattttccacaaagagattacaggtatgctgaaaatagtgccctcctcagcctttggggtggcaaggaaaagccagacacaggaatctgcagctaggtccccttttcatttatctcagtaggctggaccaatattctcattttttgtgagtgaaaaacattgggaagaatgggtctagagtattgggattacagccctagtggggaatggattgaagagagaagagagtaaaaataggaatatatcagtggctaccagaagggaacttcccaatgctattttctttctcaaatattctggtcttcggtatgttttctgtatgcccaatgtccattgtttacctaaaatagtagttcagtaaagaaggctctctctctctctctccctcttttaaagcccttgtttctaaacaaatcttccttgtctggatactgggtaaaaattttaaaaatgatgaggagccatttcgggagagaatcagtaaaatgtatttgaaggatgtgaggaaaatagatccttggggaggtaggaattgatgacaaagtgacaaatcaggaaacagtaataggatcatggtgaagttagaaaactgcagaacaaacgaactttccatatgacttaatgagacagcacaaagtggtttaggaaaagactgtgcttagatacacagcttgtgcttaaggactcaaattacttaattaacaaaaggaacaagtaagtatttcttctttttttcatctgtcacaaattggttgaactttcccattatgacttatacaaagttgaataaacacatttgacctaactaaatattgaatgctggcagggtactaaccactaaatggcagtttgggtacaaatcatctatcatcattttttattttattttaaatctcatttgggctaatatattagagatgtgaccatagagtataaatctgtaacccaggaaggaaaatagtttttcagaaaggaaacattaataaaggcaaatctgctctctttcttcaagcttcaccgaaaacacaggatatgactttgaagtcattacttcaaactgggaattcattaacaattttctcccatttgccaactggaaaactgcaaggtctttttttttttttaccatggttaggtagaggatatttttagaattttaaaatattttcttcataagctctaaaacttaaatcaaagtaaggtcaaggcataacacagaatccttaaagcccacatatccaaattaatttaaaaaatactccctgatattccatatggtattgaatagcatgggctttggagtcagacacactaaggtttgaatactgcttgtgccatttctgtgtgtctatagaggccgtatacttaaactttgagagccctggttccctcaactataatagctaagatataatatttttctctctctagtggttttgagtattgagataatatatgaaagagtgcctggcatgtgacaggcatgcaataaatagtggctcttatttctttaaaaaggatttaatgtttaagatacaacttaaagagatgaagatttattatttaattctgtatacatgattattagacaatgatgattataataactttgatttacaattaataagctcttattcatcttgtgtatctttgttccacttcttattgcttttattttgtcatgatgttatttttccttgctatgtaagtctgtagagaaataattcatttaaagatcttcacatttaccattctctcaaagaatggaattggaggctgggaataagaaacaagaattctatatgagttagtgatacatgtaaaaattaaaatggaaaaatgtgattttataactacaaaagattatgagttgtatttcaattaacatagggcattcatctaatataatgaaaatagaaaaaacctgacaagatctaagcagaattctagaaggtatgatgctatttttgttgcacattttccactatttatgaagtaattttgggggggttaatgtacttttttccttagattacttactctttgtcctttaggaccttgactcccaggtggtcctcttgcccccacatgaccctatatgttgtaaatttaaagtcagttgtagaatttacaagaatactatcagaataatagccataatctttcttataacatatatccttctcccaggacatttttacaattgattagtcttccttaaaaatatgctttaatcacactgccctctaccaatattctgcttttgaaatattctactatttggacaaatttaatgtctgggtgtttacaccctgaataaaaaatggagaagcttttaatattcactgaccaagtcgttttcagaaggaacacatatggagtgatggaggaaggagatatccattgagctagacagaccggtctaatctgcctggcccatcaaaaaagcaatggctatcatggtaatatttctttactattattctagatatttatgccaatcccatcacataaaaatagtttttttgttataaaaatgccacaaaatgttccaaattactatgctataaaaatagcctgcaatggagattaagttgctatttattattaagtcaattataatgaattatttttatagctatagtctttaattaagactcaactggaaaacaaaatttatttatctattaacccaaggtagataaaaatgaagtaaactttagtatttcaaatttatttattattttatgtgactaaagatattagtaactgttcttgagactactcttcctaattttaaaagccaacaacatatttgcaaatatactagaaaattgggcttatttttaaaacagaagcttcacaaataataaaagtcttcactgataagaaaagttctgctcaggggatcctaaaggccgatcttgttcatattttaagttcataatagctgtcagattctgataagcaaaattaatttaggggaaacacttcatcatctttttgtaaacaaatggaatattttcaatactacaatttttgtttaataaatacatatttttatgaattttatctggttgtgataatatttacaaatttctgagaaaaatatgttgaagcttacacttgtaatttatttatccaattggtctcacttctaatcttaataatcctgtttccttatatgtggttattcaaaagaaacttcaaagcattttagtttaggttgcagaactgaaattgattgtataccaagtagaggtgaggcagttcaagatatcatgacaaattcaagagtgttttgtatagttgggagagaagcagtctccactagtttacacatgacttactttgaataaaaaccaacaataaagcataacaatttatgagtttaaattaaagtaaacattccggaaggaatcataaagtctttcctgtacttacaggtaatcccaatggaccgataggtcctggaaccccaggaggacctggatatccctataatttaaggaaaatataaaagaagtaaaatattcatgactttaaattattttcattgaagacaagccagtaaattataaacaataataaaaagggataatttgacacaatgtttcttttgtaaccaagatatgaaaggccacaggaaatattctgcagatagaccatagaaataaaaaaaaattttctgtagttttatttacatagaaactatatatccatttattagaaggtttttgcctagagaagaaaattgctagctagaatcacatactacagcctatttataagagaacattcatttcatttttctgaagatcatgttatcttatccatggatatatgttgtgttatataggttatgaaactatatccttttcggagaggtccaggagctctctaattaagcaatgtaaatgtgtacaaatattctagcatttcaaactttagaaggaccacacactttatggtattaacactgattcaaaaaatgcgttaggaggtaatgattcttgaagttgattagtcttacaggcatgctaaatttcctagctgacagcaactggaaattgcatagcttaaaaaacaaaacaaaacaaaacacttataggacttttctgataatatagaagttagttaaaatcaatttgtagacagtattatgtgccaccagatccattacaaggcattttctgtatggaatatccttttattgataataattattcactccagttcctgccatacttagaaaactatttagtaagttaaaaagatgtaacccaaatataaaatttgtcagctatttcctatattaaaagtgtaagagaataagatgaattctggattctaagctctcatatgtcaaaaaactacatcatgaccacaaactcatggaagaatggcagtgctgatatgtgtcatatcaacaataggctgtagaagaataagtagaactctaattttaaaaggtgaaagatttatacaatccgaagagaaatcacagtatgtagaattctaattgaattttcttctttatcttttttagcaaattgtggtggtcaaattcctttcctaaaactagaatcatttgactaagccatctcatttacatgcttttgagtaccttagtatcacatagcattctgggagataaaccatttaaaaataaaattctatgggaaatttaacattttttactcagttaaattccagcccaggcaattccatctctggaacgacttgcttttattgcattctttggaaacatatttttcaaatcactgagctcttaccataacacctttttctccctgcggacctagtgggcctggacttccacgttctcccttttaagagaacaaagaaaaaagagtaacatagaggcatattaattagtcatgactgagctaagcctagaaagaaaaactgtcatccagaatcatgtcttacatgcatacatcatttttatttccaataatttttaaatttacaaatttggcgctttatcttaaaattattagacttttaataaaatagaattatcttaagatgttttttggagaaaaatattaaagtccttattaaaatgaagaaaatagaaattatggataaacaagacttaaaagtgagcacacatcatatgttaaagttttgtaagaaatgcttactattttatgagacatacaaaatatgagaatagtgaaagtatcaaagcatattaaaatgtaacaaatctgtgtaaccatttaagaaaattttattttatagtctgcctaccacaattaagtgccataagaaataagtctggaagatcatgataatcaaatctgtcatagcagcttaaaaagactaaactgattcacattaaaattctcaagagtatcaacattttagtacagaagatttaactcagcacagaaataactaattgggtgaaaaaaattataatgcaaaattttttaactgcactcattttgttacattgttagtaaaaaatcaataagtatatattaagtatgtagtatttaagtaattgagaatgtagtacatgagagttagaagagatatttaaaaaactaaacttagattctaccctcagtaactgcagacactgcagacatgatattaacagagatgaaacaaccagagagtaagtaaattttgactatgtggtactattctaagtccaagaagtgaagaaattaggaaggatgagaggagtctgtggacttcatagaggagatgggaattcagctgagtccaacagtttggttttgaagaaacagagggaaggagagaggatattttagttcaagaaaatagtaagaatggaaataggaacaagctcaagcacaagatggggagagagaaaggtaaaatggtaacttattcttctttttcaaaaactgctttctttcaagcctctcatagaaggcttgctctcatgaagtcgatttacataatattttctagtcagaaatctagactgttccatcttttctcttcagatcacatctttataatcaaaagggtactctgccctttaaaaattagaaacctacatgctgttagctatatttcaatatatttaagatattcagtataggtaatgtgctaaagttataagtgatttctaattaacataaaagatcatatgaaagtctgccttttgaatttagcctagatttcttcctataaaacaaaataattcttaaaaaattaccttttcgccaatgcttccagtcatcccaacttctccaggtaagccaacaggtcccttttaggaaaaaaaaataacagaaaatacacacatattgtattgctattgtagtgcctgggtcttaaatcacctgtaatcactatgtttctttctaacttatcctaaatgttatcttggagtaaaattcctccttgtatagctatgcagtctgtgacttcatatcagaattaatttattcagtcagtcaacaaaaatatatcagtgcctaaaatataacaggcactacgctgggaggcaatgagtttcaaatccacagtcgctgtccatgtggaactgacatgctactagattttataaaacccctgacgttttcatacctgtttgatgtggatatattcgtttaagaaatcatttctgtaactaccttttttgaaagcccctcaatacacaagcggacagaacatgcctatcattcattcatccactcaagaaatatttggtgcctactctgtgccaggcactgtgatggttgctaagatttcattactgaggaagacaaatctagaccctgccctcttgaggcaaaaagtctcataacagggagacaaaagcaactaaattaaaagttaaataattataaattctgacataagctcataaaggaaacaataatattgctgaagaggagaataaaagagaagacctattttagcacagatggtcagggaagactgaggcctgacatttaatatgaaatctgaataataataagaggccagccagccaaagaagggaggaagaatattctaggtagagtaaatagcttgagtaaggaatgaatttgatttgctagaagatgttaaagaaggtaatcagttacaccatttcagagtgaacacgtctcagggtttttccatctttgtctttacggattctcaattatttctccttcaaacagtacagaaagcaaaaagaataacacagaacaagcttgacaagaacataatctctttcttgtcttaaatcataagcagttactttctacttttatttaaagacaaatgaaacttttttcaatagctaccatgcaaagaccttgtttagatagattctcatacgatagtatacattagcatacagaaagcactgactcatgaaaaatgacttgtcatttatctaatgcattgagcatgattttacccttacagatctctatctatctaatgatcccatatatataacatatattaagtgttttctatgtgcctgatttaatcttcacaaccagcagatatagtattatcatcattcccctttgacagatgaggcagatgaattaaacagtttgctgacacagatgaggttaaatggtatggatgagtttaagtggctattgagcacttgaaatgtggttagtgcaaattgacacatactgtaaatgtaaaagacaccagattttgaagacttatagaaagaatgtaaaatagctaactaatgattgcttacatcgattacgtattaaaatgatactgatttgatatattggtgtaaatgaaatattactaaaatcagttcacctctttctttttatcttttttaatgtggctactagaaaatttaaaattatatatgtggcttataattttgacttgcattgtatgtctattggacagccctgatgtatacttttaggcactatgctaatattattgcttaaatctagttggaagtgatttaataatttgtttctgtggtttttaagtgtaagagactgaacactttcattctgagacaatctattatcaatgttcatgtgcatggaattcactggtctcactgtgttctccaccattctgagacagctggtttgataaaacggtgaaatggcatttttaagactcagttacaaggccagctaggtgacaatactttgcagggttggggcaagactttccagaaggctatatatgctctgaatcagtgtccaatatatggtgctgtttctcctataactagtattttggggtccaggaatcaaggggtggaaatgggagtggtactactcactattacccctagtcatccactagaaaattttttgtttctgcccatgctctgctggactaaaggtcttagttccagagggaggaatgcttccaccaggagacacaacgatgattccactgaactagaagttaagactgccatccggccactttgggcttcttatgcccctgaatcaacagccaaagaagggagttactgtgttggctatgttgcttaattctgccttccatagggaaatgggaccttcacaatggaggtaaggaagagtgtgaataaaatacaggagatcccttaggatacgtcttaatatcaccatgctctgtgattaaggtcaatggaaaattacaacaacccagttcaggcaggactacttactagtgacccaaattcttccggaatgaaggtttgggtcaccccatgtcttagtccatccaggctactataacaaaaatattgtaggctgggtgactttaacaacaaatatttatttcccacagtgttggaggcttagaagtctaagatcaaggcaccagtagattcagtatctagtgagggcctgctccctggttcatagatggcagagccctcatgacctaatcatctcccaaggtctacaccacctcataccttacattggtcattagaatttcaacatatgaattttgcagaggataaaaacattcagttcataataccccaccaagtacagatcccaactagctgaggtgcttgctgatggcaaacggaataaagaatgggtagcggagaaggtagttttaaatacctgctatggccatgtgaccagttacagaaacgaagactataattgtcatgagtatttcatcgttattttgtcatgaatgtgtgtgtgtgtgtgtgtgtgtgtgtgtgtgtgtgtgtgcagcaaatatctttggttcttttcttctcatttctttttttcttttcttttttttttttttcttgagatggagtctcactctgtcacccagcttggagtgcaatggcgcgatcctggctcacagcaacctctgcctcctggcttcaagcgattctcctgcctcagcctcctgaatggctgggattacaggcgtgcaccaccatgcctgattaaatttggtattttcagtagagacagggtttcaccattttggacaggctggtcttgaactcttgacctcaagtgatctgcccaccttggcctcccaaagtattgggattacaggtgtaagccactgctcctgccctctcatttctttatcatataacataagacgtattgaccttataacagtatctaagtatggttaattttacatcatagtatttaagttacaggttataaaggagaagagtaaacatcactcaaggactttacatcctcttctggaaaagaggttagtgagtttttggttacatgcaggataatgatatcatgttaggcagaattatgatcttattattgtctttatttgaaggttaagtatggtttaaagagatgcatttgggggcaaacttgacaatggggagggctgtcacggttaattttatgtgtcaaggtcactgggttacagagtgctcagatatttggctaaacattatttctgagtgtatgttgtttctaggtgagattaacatttaaataggtaaactgactaaagcagattgcctttcccaatgtgggtgggcactgtccaatctgttgaggatctgaataaaacaaaaaggcaaaggaaaggaaacttttctctccatctgactgcttaggctgggacattagtcttctcctgcctttgaactaggacagcattgactcctagttctcaggcctttggacttggagtagaatttaaataatcagtgctgtaggtctcaggcctgtggactctgatagaacttacactgtcaattcttgtggttctcaggcctttgaactcggactggaactatactggatttctaggatctcctgtttgtggatggaagactgtgagatttttttttagccccccacaatcatgtgagccaattctttataataaatcaatctatctatatctatatcctgttggttctgtttctctggaaaaccctaactaatgctgtcaatcaaatctgagcaggaaaaatgaaatagagctatctgttgtgagacagtaaacaaaataacagaaactgaacacagactagtcaaactattcggaaaaaatcatttttctttttgagacagagtctcgctgtgtcgcctgggctggagtgcagtggtatgatcttggttcactgcaacttcagcctcctgggttcatgcaattctcctgcctcagcctcctgagtagctgggactacaggcacagagcaccgtgcccggctaattttttgtttttgtttttagcagagatggggtttcaccatgttggccaggctagtctcgaactccagacttcaagtgatccacccgccttggcctcccaaagtgataaatcctttttctaagacatatgatctaggggagtgaatgcagtaggctcgtttagcttatcccatgtgcaccagaacaatataacctacaaatgtattctgcttagcctatagcatttactaaactgaactaggtaaaaacatttaaaaatctggagattttacatataaatactttatatataaagatttataaaattattagcttcagatgacctagcaaatgtagacaaactttctcaaaggcaaatattggacagaactaagtaactgttgtactgttgagatccagatgcactctttactttgctattccctattgtctcttatacatggcccattttacttatttatactatctgcctggtcccaatagggcatctgagttttttacttcatgtaagtattaaaaggtgcagtcagtcaaaagggcataattggaagatagaggttctcactaaaaagtagatagttcacagggttccggccatgcccatggatatctttaataaaacttaaagttggagaacataaattaaaaatggtttccttgcagcctaggcaacatagggagatcacatctctataaataatctatacataataataataaaattagctgggtgtggcaacatgttcctgtagtcccagctactcatgaagctgaggtgtgaggatcgcttggactcaggaggtcaaggttgcagtaagcctgagtgacagagcaagaccctgtctccaaaatacataaaaagaaaaacgtactatttcagtaccttaaaaagtctaaccaaaacatatgtcaaatctgataataccacaagtgttggctagaatgtaaggaaagaagaactcatacatacacagcaggaaatagcaggaaatagtataaattggtacaatcactttggagaacaatttattatatatagtaaaattgaagatgcccctaacttacaactcagcacttctagttgttcacatggaattctactttcacatgtatgtactaggagacatatagaaagacgttcattgctgtattatttaagtacaaaagtagaatcatcggcattatcagtatggacacagattaactaaaatgcattcatacaataaagaaaactcttgaatgaccaatactgagaaataaacagaaaacctcaacaccagctaaaattaatagaccagatctatatgtatcaacatggataaacattttaggaatataatgttgactgagaaaacagcataaatccttttcaaaaggatacatcattatgtgttttgtgcaaaattttaaaacgcatacaataatctaatttcttactggcagaagacacatgggaattatacacacaactttaggataagggctaatgtctgtatatagagtagtggctcattatttttttattttgaatttctctgataactagtttctctgagtctgaacttctcttcatttatgtgttcatgttttggactttttctgcttagttcttatccatgtcctttgctcaacttattttttcccattaagatttcctaaattttcttgatgattttcaggaatttttatatatttgaagtataaacttcttattggttttattttattttatttattcatgttttgggctttttctgtgtaattcttttccatgtctttgctcaatttattttttcccattaagatttcctatattttcttgatgattttcaggaatttttatatatttaaagtataaacttcttattggttttatttatttatttatttatttgagatggagtcttgctctgtcgcccaggctggagtgcagtggcatgatctctgctcattgtaacctttgcctcccaggttcagcttgatcctgccacctcagcctcctacctcagcctcctgagcagctgggactacaggcatgcaccacgacgcccagctaatttttttgtagtttttagtagagacggggttccaccatgttggccaagctggtctcgaactcctgacctcaggtgatctgcccgccttggccttccaaagtgctgggattacaggcatgagataccgtgcccaaaccttattggttttagatgttctaaattccttcttgtgataaatcacctgtgaaattatttttgatatctttcattgacaagaagtccttaatttttatgtggccatatccagtgtggtttttgtttttttttttggccttatgatttgtattttctggatcttgtttaagaaagctttccttatttctatgtcattaaataatgggcattcttttctattgctgttaacttttctatctagaaaagtttctttaatccatctggagttcaattttcacgtggtataagatagggatccagttttaattttttgcatacagggacccagttttccaaatgctatatattcagcactatttcttacccacctattggtttatggtgccattcttgtcttatacatggcttatttctaagctttctagtctatcttatgatgatttgtctgtttttctccctttgcaaatttctctcactccatttttctaatgtttttatggttgtctctactacagactgaaaataagcatgccaacaaaggtttatatcagtggtaaggaatgtgaacatacaggctttaaatctattcagtctttaagtctatattactctttgaaactgtgtacacacttggaaataatagatgaattagacaaaggtatttaaagctgaggtctgccaaatttcatggaatctaagatatcatggattgtaagatacaccaatattttttaaatctctgaatagagaaaaaaatctcccaagcaattgtaatttaccactgatcatgagaaatatctcaatttttaaaatgtgaaaatgtgaaaagaaaaaatggtatagcagattgttttactgtttgaaatattcactgctcctttctgtggaaggattatacctccctatgctactgatgtcagacttggccatataatttggagtgcccgtcaccatgggaggaatatacccctgcatcttattaatgtcattcttctctatgtaacttcaaataaatagaaagtgatatgtaccactttttttttaagtcagtttcttttttccttttgccatgagactaaacatgttccacacaggcactgctccttaagcctgagtctccgaatgcagataacatgtaacagagtcacagccaacccacagtgtatagagtgcaagtaagaaataaacttttattattgtaaaccactaatatattcaggctgtttctttctgcagcataatttagcctaaactgactgatgcaatatgtccttttaagctgatatgacatggcaattattaacaggagaagcatgtggttttctctaattttatcccaagtgctaatgaccctaagagatagatggagccacaagaaagagggggcctgggccaggcatggtggctcatgcctgtaatcccagcactttgggaggttaaggcaggaggattgcttgaagccaggagttcaagaccagcctgggcaacaaagtgagaccctgtctctacaaaaaagaaaaattaaaaattagctaggtttggtggcccgtgtctgtagtcccagctactcagaagactgaggcgggaggcttgagcccaggagttggaggctgcagtggagcaatgattgcatcactgcactccagtctgggtgacacagtgagaccctgtctcttaaaaaataaaaacaacaacaacaaaaaccaagagagagcacctggttttcttaatcaacttgtaggggagagctacttaggaacaccttcaccagacaattaacatgggcaaaaataactttctgttgtgttaaaacaacataaaatatttaggtttacttattatggcagttagtgttatcctaaaaatacagtgaatttacgtattaacataaaattgaaaaactgtgaaatctaactcaattagtttatttgaaagttaatctcacagaaagtgcactgaatcaatttccagtttagtacagttgcaaatcaatttcttcaataaatgcaaaatgaggtgaagaaaataaaattaagcatatttatttgttcatgtaacagatcctgtgctaagatttagctggagaggatatagagatgagtaaaatatactaaggagttcaaaatccagtaaattggaataaggtaaacgtatattttctaaaagttaatagaagaagaagtaaaataatatctaacacaaaggcagaagagattatatctggttgaaaacatgagaaaagactttacagagaaggcagcatctcaggtatggttacatgttgacatgatgaaatggtgaaagtgtattccaagcagagggaatgttttgagctaaagatgggagggagcaaatgataaaacatttgcaaacacaaagttaatccacattgtctgggacacagaatatgtgtaggggaataggctgggatagatacattggttatatactatagacggctttgaataccaagtgagaaatttgtgtttgtggtatctgcagaagagtgtgtgcttgtagaagaatcactattggttttcagtaaaggaggaatataatcatatctagacttgaatgggtggtaatttaacatcactgtgtttaatgtgtagaaatgggaaaaatagaaaataggacaaacaaatcattataatagtccacattaaatgtaatgactggtatgaggacaatatcatcattaaaaaaaaacagtaagctcaggagaaaagccactgttagaggaaaagtgacgaagtaagccaacagacagttgtgcttgtaaagaatctatcttgaaatactgatttgtgtctccatagaacaatcaattgttgaaataataagaatgatgtagtacatacgctgatgataaaccaggaacaagaagggaatctaatgaagattcattggaggcaagaggtagaaaaaaaaaaacaaaaacaaaagaaagagtcacaaaagaaagagtcaaatagtcatgttccaagatggccaaataggaacagctctgatctgcagctctcagcatgatctgcatttccaactgaggtacctggctcatctcattgggactggttggacagtgggtgcagcccatggagggtgaaccaaatcagggtggggcatcgcctcacctgggaagtgcaaggggttgggggacttccctttcctagccaagggaagccatgacagaatacacctggaaaatcgggacactcctgcccaaatactgcagttttccaacagtcttagcaaatggcacaccaggagattatatcctgtgcctggcttggcaggtcccatgcccatggagccttgctcactgctagagcagcagtctgagatcgacctgtgaggcagcagcctggcagggggaggggcatctgccattgctgaggcttcagtaggtaaacaaagtggccaagtatacaggcaggtgcccctctgggatgaagcttccagaggaaggatcaggcaaaaatatttgctgttctgcagcctccactggtgatacctaggcaaacatggtctggagtggacctccagcaaactccaacagacctgcagctgagggacctgactcttagaaggaaaactaacagaaaggaatagcatcaacatcaacgaaaaggacatccacacaaaaaccccacctgtaggtcaccatcatcaaagaccaaaggtagataaaaccacaaagatggggagaaaccagagcagaaaagctaaaaattccacagagtgcctcttcccctccaaaggatcacagcttctcagcagcaactgaacaaagctgggcagagaatgactttgatgagctgatagaagtaggcttcagaaggtcagtaataacaaacttctccgagctaaaggaggatgttggaactcatcgcaagtaagctaaaagccttgaaaaatgattagatgaatggccaactagaataaacaatgtagagaagaccttaagtgacccgagggagctgaaaaccatggcatgagaactacgtgacgcatgcacaagcttcaatagctgattcgatctagtggaagaaagagtatcagtgattgaagatcaaattaatgaaataaagcaagaggagaagtttagagaaaaaataataaaaagaaacgaacaaagcctccaagaaatatgggattatgcgaaaagaccaaatctacatttcattggtgtacctgaaagtgatggggagaatggaaccaagttggaaaacactcttcagggtattatccatgagaacttccccaacctagcaaggtaggccaacattcaaattcaggaaatacagagaattccacaaagatactccttgagaagagcaactccaagacacacaattgtcagattcaccaaggttgaaatgaaggaaaaaatgttaagggcagccagagagaaaggtcaggttaaccacaaagggaagcccatcagactaatagcggatctcttggcagaaactctataagccagaagagagtggggggccaatattcaacattcttaaagaaaagaattttcaatccagaatttcatatccagccaaactaagcttcataggtgaaggagaaataaaatcctttacagacaagcaaatgctgagagattttgtcaccaccaggcctgtcttacaagaactgaaggaagcactaaacatggaaaggaataactggtaccagctgctgcaaaaaacatgccaaattgtaaagaccatcaatgctaggaagaaactgcatcaactaacgggcaaaataaccagctaacatcataatgacaggatcaaattcacacataacaatattaaccttaaatgtaaatgggctaaatgccccaattaaaagacacggactggcaaattggataaagagtcaagacccatcagtgtgctgtattcaggagacccatctcacatgcagagatacacataggctcaaaataaatggatggaggaagatctaccaagcaaatggagaacaaaaaaaaaagcaggggttgtaatcctagtctctgatgaaacagactttaaaccaacaaagatcaaaagagacaaagaaggccattacataatggtaaagggatcaattccacaagaagagctaactatcctaaatatatatgcaaccaatacaagagcacccagattcataaagcaagtccttagggatctacaaacagacttagactccaacacaataataatgggaaactttaacaccccattgtcaatattagacagatcaacaagacagaaggttaaaaaggatatccaggacttgaactcagctctgcaccaagtggatctaatagacatctacaggactctgcacctcaaattaacagaatatacagccttctcagcaacacatcacacttattccaaaattgaccacatagttggaagtaaagcactcctcagcaaatgtaaaagaacagaaatcacaataaactctctctcagaccacagtgcaatcaaattagaactcaggattaagaaactcactcaaaactgtacaactacatggaaactgaacaaccagctcctgaatgactactgggcaaacaacaaaatgaaagcagaaataaagatgttctttgaaaccaatgagaacaaagacacaacgtaccggaatctctgggacatattaaaagcagtgtgtagagggaaatttagagcactaaatgcccacaagagaaagcaggaaagatctaaaattaacaccctaacataacaattgaaagaactatagaagcaagggcaaacaaattcaaaagctagcagaaggcaagacataactaatatcagagcagaactgaaggagatggagacacaaaaacccttcaaaaaatcaatgaatccatgagctggttttttgaaatgatcaaaaaaattgatagactgctagcaagactaataaagaagaaaagagagaagaatcaaacagacgcaataaaaaatgataaaggagatatcatcacggatctcacagaaatacaaactaccatcagagaatactataaacacctctaggcaaataaactagaaaatctagaagaaattgataaattcctggacacatacaccctccaaagactaaaccaggaagaagttgaatctgtaaataggccaataacaagttctgaaattgaggcaataattaatagcctaccaaccaaaaaaagtcaaggaccagacggattcacagccaaattctaccagaggtacaaagaggagctgataccattccttctgaaactattccaagcaatagaaaaagagggactcctccttaacttattttatgaggccagcatcatcctgatacgaaagcctggcagagacacaacaaaaaaagagaattttagaccaatatccctgatgaacattgatgcaaaaatcctcaataaaatactttcaaattgaatccagcagcacatcaaaaagcttatccaccattaccaagttggcttcatccctgggatgcaaggctggttcaacatacacaaatcaataaacataatccatcacataaacagaaccaacaacaaaaaccacatgattatctcaatagatgcagaaaaggcctttgacaaaactcaacagcccttcatgctaaaaactctcaataaactaggtattgatggaacatatctcaaaataataagagctatttatgacaaacccgcagccaatatcatactgaatgggcaaaaaactggaagcattccctttgaaaactggcacaagacagagatgccctctctcaccactcttattcagcatagtgttggaagttctggtcagggcaatcaggcaagagaaagaaataaagggtattcaattaggaaaagaggaagtgaaattgtccatgtttgcagaggacatgattgtatacttagaaaactccatcgtctcagccccaaatctccttaagctgataagcaacttcagcaaagtcttaggatacaaaatcaatgtgcaaatatcacaagcattcctatacaccaataacagacaaacagagagccaaatcatgagtgaactctcattcacaattgcttcaaagagaataaaatacctaggaatccaacttacaagggatgtgaaggacctcttcaaggagaactacaaaccactgaacaatgaaataaaagaggacacaaacaaatggaagaacattccatgctcatggacaggaagaatcaatatcatggtaatggccatactgcccaaggtaatttatagattcaatgccatccccatgaagctaccaatgactttcttcacggaattggaaaaaactattgtaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagctatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacctaaatgttagacttaaaaccataaaaaccctagaagaaaacctaagcattaccatccaggccataggcatgggcaaggacttcatgactaaaacaccaaaagcaaaggcaacaaaagccaaaatagacaaatgggatctagttaaactaaagagcttctgcacagaaaaagaaactaccatcagagtgaacaggcaacctacagaatgggagaaaatttttgcaatctacccatctgacaaagggctaatatccagaaactacaaagaacttaaacaaatttacaagaaaaaaacaaacaaccccatcaacaagtgggcaaaggatatgaacagacacttctcaaaagaagacatttatgcagccaacagacacatgaaaaaaatgctcatcatcactggccatcagagaaatgcaaatcaaaaccacaatgagataccagctcaccccagttagaatggcgatcattaaaaagtcaggaaacaacagatgctggagaggatgtggaaaaataggaacgcttttacactgctggtgggagtgtaaactagttcaaccattgtggaagacagtgtggcaattcctcaaggatctagaactagaaataccatttgacccagcaatcccattactgggtatatacccaaaggattgtaagtcatgctactataaagacacatgcacacgtatgtttattgcggcacaatagccaaaacttggaaccaacccaaatgtccatcaatgacagactggattaagaatatgtggcacatatacaccatggaatactatgcagccataaaaagggtgagttcatgtcctttgcagggacatggatgaagctggaaaccatcattctgagccaactatcacaaggacataagaccaaacactgcatgttctcactcataggtgggaattgaacaatgagtacacttggacacagggcggggaacatcacacacgggggcctgtcatggggtgaggggcagggggagggatagaattaggagaaatacctaatgtaaatgacaagttaatgggtgtagcaaaccaacatggcgcatgtatacctatgtaacaaacctgcacgttgtgcacatgtaccctagaacttaaagtataataataataattataataataataaaaagagtcaaaaaggaggagaaccaggaatgcacaaagaaagatacagaaaataaaagtttcaagaagagagaaatctgtgtgatgtgggaaggtttaagaaggatgaacattaagacaaattcatagaatttagcaatcaccaggttgatggtaacctgtaggaacaatttcagtagcttttgtgtgtttggatatgtttgccaaagggttaagaatgtgtgtagggggaggaggagccaagacggccgaataggaacagctccggtctacagctcccagcgtgagcgacgcagaagacgggtgatttctgcacttccatctgaggtaccgggttcatctcactagggagtgccagacagtgggcggaggccagtgtgtgtgcgcaccgtgcgcgagccgaagcagggcaaggcattgcctcacctgggaagcgcaaggagtcagggagttccctttccgagtcaaagaaaggggtgacggacggcacctggaaaatcgggtcactcccacccgaatattgcgcttttcagaccggcttaagaaacggcgcaccacgagactatatcccacacctggctcagagggtcctacgcccacggaatctcactgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaaaaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagttacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaaccctccaagaaatatgggactatgtgaaaagaccaaatctacatctgattggtgtacctgaaagtgatgtggagaatggaaccaagttggaaaacactctgcaggatattatccaggagaacgtccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaatagcggatctcttggcagaaactctataagccagaagagagtgggggccaatattcaacattcttaaaggaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatagtaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcagtcaaagccgctcaactacatggaaactgaacaacctgtacctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatgaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcagtaatcaacagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatacagcatataaacagagccaaagacaaaaaccacatgattatctcaatagatgcagcaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactataccacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaagctactcatctgacaaagggctaatatccagaatctacaatgaactcaaacaaatttacaagaaaaaaacaaacaaccccatcaaaaagtgggcaaaggacatgaacagacacttctcaaaagaagacatttatgcaaccaaaaaacacgtgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagtccaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagattggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaaaaaaaagaaagaaagaaaaaaaaaagaatgtgtgtaggtgaagagaaaatgtaaaaaacttgtatagtttagatgattattttaataagttggcagcaaaaatgaggaggcatgaaaactgctaaaggatgtggttgcaaaattactctattcagtatctaatttttgctgtcagccaaatagagttcatcggcaatagaaaatgtacccttctgaacagaaataaattacattaaaaacctacgtttttgctgtgtttcacagaataattttttttaacacactattattatggcctaatctatcacgattggttgggaaccaacacactgtaacaggagagaagatgctggcaggattaatcttctcccaaagactatttcctagccagctccctacttctagatagctttcctacacttggaatgctccatccagggaaggcatgtattgtgcaaaggtgccatataacctcttccttcttaacagaagtactttctgaaaggcagactaaggtgctgtgacttattctcatttttttccatgaaacttcaagtatcatatatgctagtgagaatcagacaaatgcaagtgagaatcaagggcaaaattatattttcaattgtaaagttgtcaaaggcaaattatgtgcatgtggaaatggtcataatttatttatatttactactatagctctttaaaatagagacatgggtgaattctggtttgttcctatttattcttcttcattttaaaacaaatgttgaaatattatgtattactattttagttgtctactgctgcaagacaaattacccccaaaagttagtggttaaaataataaacatgtattatctcacagtttctgtgagtcagaaattcaaaggtggcttaaatggttagttctggctgaggatctttcatgaagttgcagtcaagatttggcattggctgcagtcatctgaaggcctgactgaccagaaaatccatttccaagaaagcttatttcctcaatccatagacctgaggacatagtagttggcttcccccagattaagtgatgcaagaaagagagtgagaaaggaagaagctgcagtgcctttatgatctagcacacattgacttctgccatatcctactcattagaaatgcataactgagtccatcctgcattcaaaaagagccaaagtagactgcacacttcagatggaggaatagaaaagaatttgtagatatatttttaaacaatcacaatgatttaaattctattcttggcttgatttgatattttattaagactttgactcctcccaatagttttctttagtttcttgcatgtatttttaagttatacacttctttgtgaacactctaaattagtgttgttggaataatgtacattttcctacagatgaaatgcataacatttcattcttattagttattatctatcatgaataaggtactatagtagtcaatttagacatcactaataactaaaatataaagtagatagccaaaaatgccagaagatgaactactatagaatagcagataaaacaggaatgagcaatctatggctctgatggctggctgcctgttttgtaaatagtttcattggaacacagacttgcccatttgtttacttattatctgtgactatttccacattatgcaggcagaactgagtaatttcaacagagaccatatggcccacaaagcccaagtcatttctgctggatatttaaagaaaacacaaaacagtcactgagccatagccagaattattgtcaatatataccaagaatttacattaaaaatatttcaaaacactgattccacatctaacacacaattaaaaaaaaaacaccaagcatttagctagaatatgctgtgtttcaagatccagacaaccatataataattgaaaacatttcacttttggcaaaatagtatattttgcaaaatggtctataaaaactttaaaactctctcctaatattttttaaagtaactatatcctatttattaactaaagactgatttaaattagaatatttcctgtttgaaactaaaaaatttttaaacatttatttaaaagttcttatgcttagatgagtcaccaaagagaatatgtagaacaaaaagaggaaaaggctacgaacaataacatttagagagttggttcggaaaaagaaaacttaaagttgactatgcataggaacaaagtgaactgtcaataggagaatactgtctatttttttccatagtgtttcttcagaccttttcattggagggtaatactatgacttgacaagtaggaatgaacactttctgtttatttataaatacatcactgtttccaaatagctaacctttggatcacttcactcctattttcaaatgaaatctgtaagctaagtatttatttgacagcatgacttgtagcaagttactttagctcactgtacttcatcctgtaccatttaggaagatgtgactttaagttcattggtctatatgctctgtaaagcagggatgatgtctgtattatcttctgtatcccaggcagtaggcataagggatacagtatcagactgaagtcatctgaaggcttgactgacagtttattaattcgggagcactttccaagtatcagactgtatcccttatgcctactgcctgggatacataagataacatacgtagaatgaatgagtgaacaacttagagcagtagtggtggaaacagaggtgagccacccacattccctttttatgacatatcttattaaccctgcaataagctccttcaagatttaggccttagcagagaggcctatatccaaagcctgattaaggcggggtataaaagtctggccatttgggcccaatgtctgactactctgatggtccaaacatttggttggtctcttccctccttctgggggattgcagagaagattgggtaaaagccaggatttaaaatcaaagtgaccaaattccagagaaggtccaactcctaaccaagacaagtctgttatgccaaagtcagggtcttggttagaaaaaaaaaaatggaactctgatacttgtgaaaacagtatctgggcagaggtccctgaagattttgaactgctagtctctgaactctaccagcttacacaagtggcctacttcttattataatttagcattctcccctaacataacctctcccctgtaagaaaacgtaacccagttaggattcccaccacctcctcttctagccattatgccaataactagggttaaatcacagcataacttgctgcacctgatataggcagaagggactatgacccaaggggataaaagatctcgtcagtatgtactggtaggagaagggggcatatatgtggatctgattgcacaggtatttgatcaagagaaccataatataacataaataacataaaattagatacggaaaagtttattaatttgggagcactttccaagatagaggaattaacactctggcaaggaccccaggaggttgcacaagctcctacagtgggtccaagctgtgaggcaagcagtcctgtactttgggccacatgacctggcagaccctacggtattagaggaatcaatggtggaaaaataagttatgcaaagcctatgttaagccttgatgggaagatcacagtgcaggctcctgagattttgtatcaaggctctgccacctgcagcagagatttaaacacattttgaaaaatgaattccagcataccggtagccttagtagagtctgggcacttaatcacaggacaccaaatgactacacatctgaatctcctataagctgagttccatcagattcatcaagtcataaggccaaccagttccagtgcattctgggaaggaatatgagcaacacagaggcacaagcagactgcataagcaagttgtccatattcccagccagtacctcttctttagctgacacctttgctctctgggggatcccttacgaccagctgtcagaaggagaaagcccaaacttggtttatggatagtaggcttcttacgtaggtgcaaactgaagatggatggcagctgagctacagcttcacccagaagtgccttaaaaggcagtaacagggaacatcttctaatgagcaagtctcaggcagtgtaccagatcattcactttgtgagcaagagaggttgcttgaggttagaataggtacagactaatggaaatttgtgagtgacctggctggttgattaggcacctaaaaggaagaatattgtaagactggggccaagaagatgtgagaaacaggaatatgggaggacatactggagtaggcacgaagtgtgaagatctttgtatcacatgtcaatatttaccagagggtcaaacatgaaagagtatctgcaggtagatttaatgactcagaaagctgacatcagcaagccttgatcatcagtcacttcagtgctggatgatggatatatgaatggaatggacatggtagaagagatggaaggtatgcatgagtctgacatcatagggtgcaattcaacaaggctaatataaatactgcttccactgaatatccaaactgccaacaacagagaaccatattaagcccacaacatggtaccattctttgagaagcccaaccagctagttggaggcaagttcattctggaaaggccaaagatttattctagcagaaatgacatatgctttgaaaatgggtggccttccccacactgaggcctcaattagtaccagtatttagtagcttaaaaagtgtctaatttaccatatgggatccccaaaatattatgtcagagcaggggactcattttatgcaaacagtgcagaagtgggcctatgaccatgagatctaattgtcatattacatcacatcaagaattttccaacttgagagagcattggaatagcctgctaaaggtacaaactaaagtgccagctaggaggtgatgctttatgaggatgaggcactatcctataggatgaagtatatacactgactcaaagacatttatatggtactgggtctctaataggaaatatggatgggtctgaaaccaaagtgtggaagcagaattagttccacttactatcactctcaatgtcccagtggaggactctgtgctttccattcccacaaaatgtgagctctgcagacatggaggccctcgtcctcaaagggaacacattttcaccaagtgacacagtgagagtctcactgaactataagctatggcaatctcttgagcccttcaatttccctgtgtccacaccccagcaggcaaaaataagtcaccatcttggcacagttaattcaccctgatcatcagaagagggagaagattaatatcactgaagtcttaaaatcagctgcagtgctaggggctgtaatttgtatgactgattcctcttctaagcttccctcaggaagagaatccactagaatcctaggacagcatctccctaaaaggatatgaagaagtagatccaagcagaacaaggagtagactgtggtgaacaccaagatatgcttccaaggtactccttcaaggaagaacttgtgtggcccaagctgtcagtagcttcatggtttgccttagttccagagagccttcttgaccaaaggtacatatacctttcccaggttggtccatatacagtgactgcttggagtaaactataaaagcccagttacttaagcctagcatgggactactcagatgggtcataaaggatttagagcttcttgcgggggtggttgaaacttagtagggtctgtgtcacagattgacttcttcctctacccaatcctgtttcttccctgactctttctacaactgttgcttcctaataaataccctgtagcgaaatgccatctcagcagtttgcctctagaaaatccaatgtgtgctcacagtttttctctaactgtggaactcaatccattgagggccatggaaatactgaaaagtgtcaccaaggttatatacagccactcagagtagactagatacataaaacgtatctaccgtaaatgatcctcattcttgagaacattggaaacaactaagatagaatctcttcttaaccaaaatctgtggttatggaaaaaatggaatttatacctttattcaatgttcacttatgcttgatggacacaacaactatcatacctagcagtgtggctcctaatgttcactgtagtttcaatgtctgggtaagaactgttgctatccttaggaaacacagaatgttttatcctgccttcctataaggaagaaaattgttcattacatatatatggtttctggggattggctcccaagtccaaagtgtaagaaaatagcatttggtatgtatcccaaatccaacctaatggagattctctgagacagcatctggagtgagatactcattcctccttttccttcatactaagtaataaatcttttcctgatgattggctggaggagaaaacttatagagctcaccaaagactgaagacactttgacagcaaaagctatagctttttataagttttttttggaatatttaccaaaaaatttctttaagtctatttctgtttcattatgtgcagtgtgcttatattatgtacttgcagaattttactatgccagtatctagtgcctaaggagttcaaataaaccagatgaggaaatgatgtagcacagagattatactgaatcatatctgttactgaacataggatatatactgccctcttaatttcttttctggcatgaagtagtagtataaataaataaaaataatgactactcacctgtgctatctacttactgagtcagtctttgaaactaagactgtgcctagtatgtcttattaaggtttccaaaagttgaagataaactatctacaaacactggggatgaattgaagaaaaagcaattttatacaaaccctgcattcattaacacttttaaaaagtgccataagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaagtgccataagatatattcagccatttatttagtcaagaaacatatttgagagcataatacatgcaaggcatgctaaataatgtaaaatgttttatattatcgattacatttagaatataagacaagcacttcatgattatggaggttcctgattagacaatagtctactttggagtcacagttcctccacttcagacatttggatacataaagttttataaaactgaatggtctgcttagtatccaaatagggatttcagcttctaacgtttccctaacaactatttgactcttggatcaaaaatgtagtaataaaataaaagttcagaacaaagttttgcccgaggaaggtctggcagtgatcaagagaatatgcctggaatgtctactcaacagatgcttttactctcacatttatgttatggtaaactcaagaatagaaaggcaacttgtgctgtactccctgcactaaatttgcctggcaatgttgttcacatagcctgcccttttgaatgagtctcttggtaataaatcaaaggtgataatgtgaatatcatccacctaacttggttgaacttaaggtgttattagtttcaaaaaaagtaacttggatgagaaataagaggaattctcttgctatgacacttgtattgcaaaacatctgaattgcaaactcttcccaagactctaataactagcaggaatgttaagagaatgttcagagaatatatgcttatatgcagaacattattttcacatgtaaattgttaaattagttctatatttcttccatgcagacctcataggtgttgtgttttctgaggattatatctaaagacaaactcagagtaagaaaatctaccatccgatgcctccccccactgtcaatattcccttcccctcaaatcactctaactacaaatgaggaaaatagcagcatggtatggaggattattagtctaaagacatgaattccagcttagatcttcaattctgaagcaagtctttgaaccaatttgggtttcaccttcctaattcaaaaaacaaaaaggatgggctagataattctgttcatatttttagctctaaaactctacgattttaacaataagagatatgaaaagcattcagttatttagagggtatttaaaatctctggacaggtaagaacgagacatgtacttttttttaaaaaaatggaatccttttattatttcatagtgaagaaggtgtttccagcattctgaatcctcagtaccactaagaaactatttcctgacatatctacaggaagcaggctttgtgaccactcagagcttactttattttttcattaatcctaaaaacttgtctaatcttttaaacttacttgatcttctaaactcatgtgtgctcttttgagtgtaggggctgtgctccattaattgtgatgttcatctcaatgctcatctcattgtctagcagcatactgggcacatagtaggtgttcagtaaagatatatagagtgattgcacagcataaattagatgctggtttctaaattaatatattgaaattacagaagttcccacagtgtacttaaacataggaacgttaaagtatttacttgtttaagttatgaaaaaataaagaaggaaaagtggagatcatatagggaaaaagatgttttcaagagactgcctttcttctctctttaggcaataataaatctttttgaagttctctgccagctagttagactatggttttttgaaataccatttgatagacacatatgacatttttagagctcaagtacaggatagcatctttgagatatgctgcagaaaaacctagaaagttttcctgagtggtgaagacatcattggtcggaatgaaatgacagagggtcacatttctcatttctttcttgtattgtgatttcctcttgtattacttattcctgctggttttgagtatctatcctatatggtttttgcctaagtgattggtctttccttggctttatactgtgccttccaagttagtattattggttatttggagttcttgaattttggctttgctacattgtagaatacgctaggtaaattagtaatctcattacattagttagtgccaatcataatccccaaagacacagtcctgaatgtcataatctggaatgttgaaatccaaaagatcaaaatcacaaaagttcaaaattcctaaagtctaaaattccaaaaatcaaaatcctcaacattaaaatccctaatgttgaaatcctgaaagttgaagacacctggagaagggattagtgtgtcttcagttgcatgcaggataattgcatcacgttagttacatcacattacagtggaactactgctttgttactgtctttatttggaaattatagatggtgtgaggggatgcttatgggtgccaaattgatgaggggtagactcgacttaattttaggtgtcaatttgactggtataaggaatacctaggaacctggtaaagcattactttgggtgtgtctaccagggtgtttccaaaggagattagaatgtaaccctgagtggactactagctggagaagatctgccctcaatgttagcagggagtatccaatctctcagggcctggagagaaccaatacagaagaaaaattggttgctctctgagagctggtacagacttttcttctgttgccttggacattagaattccagggcatgccagcttttggactccaggacttacaccagtacccgctatgtcctgtggctttcagcctcagactgagttacatcattggcttccatggtcctgaggcctttgtacttggacagagccaagctactggcatcccagggtctccagtttgcagatggcctattgtgataattctcagccaccataatcatgtgagccaattctcttagtaagtcctttctcatatatctgtatataaccttatggttctgtccctctgaagaatcctgactaacacaaatttggtatgggaaagctgagtatcattctttcatactgtattccttacaacacaatgaaagagatctgtgaaattgttctcccaccaaaaagttgtgataagttaagtgaatgaggctactgaatagtgaaagagaaaagtttaaaagttaattactactgatactgtgaaagcagaaaatcacttaattgcaacagttgagcaataatgaggctttcgaatagacaacatatgtttataaaatgtgtagacaacaaccactctttaaatacgagtgcagcaggtgtttcaaagattacagaagtgaaaatgcaggttgaaagtccaagaaatctgtccttccaaattatgcaataatgtgtgacttctaccccttcacacatagcaccaatttgctgcgctatgtatttcagcttcatatcattccagactggaagtataaattatgaaaagacttttagaaagttctaattcattttacgcatttttttgcaaatttgactccatgaaagtgcattgtcacaatgctgacagtgtgtgcaggcactgtgtgtatatgttaaaacattgaactttcccagtaaatgaagagatgtcctttttgtacattcgcatttgtgaaagataaaatttctacagatctcagctctttggaaaagattatatggctatgtgcatatgtagtagtgactcactgcagcttttgtattgatcttgtcaaaagacttatgttctctattacagtatttcagatgagtgcagttataaagctgggtatagacaattaccaaccataggtgacataagtttttatatatttcactttttgacctatttatttatgaatattgttcatctgcttataactgatatgcaactgtcactagaatatttgagtgtttatgcttgcaaaaatatgtatgttatcattgcctattttattaaagtagcctaggaagtgttctgttgtgttttttatgtttctcaaatacagcttattttaacaatgtaaataaatcttttttaaaaaaattttaaattattctttccagaattatattttcggatttgatcttatgagatcatagccgaaatccctcattagtacttcacaggtaggacagacacttcctctgtgtagagaagagactcttttttttttattattattatactttaagttttagggtaaatgtgcacaatgtgcaggttagttacgtatgtatacatgtgccatgatggtgtgctgcacccattaactcatcatttagcattaggtatatctcctaatgctatccctcccccattccccgaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtgtttttttttttttttttttttttttttttttttgagacagagtttccctctgttgcccaggctggagggcagtggcacaatctcggctcactgcaacctctgcctcccaggttcaagcaattctcctgcctcagcctcctgagtagctgggactacaggtgtgtgccaccatgcctggctaattttttgtatttttagtagagatggggtttcaccgtgttagccaggatggtctccatctcctgacctcatgatccgcccacctcccggcctcccaaagtgctgggattacaggtgtgagccactgcgcccggccgagaagagattcttaaatataataatacataacaacattgtactgaaaatcctgaagcttaaggatgccctgactgactgaaaagttgaaacaattttattaaaaaattatatgtgacttcttcagttaaaccttgagtgtggttttgtatgacctttctcttgtactggagttctgtagcatatagagcagaaagcaagcatatattctcatccttgagaatactgatgactgagaccttaagaccatcaccaactgacctgctaactactgccacagatgccagataggttggtctaattatgtggcaactagatacatactaagctagatcttggagtggggtgagtggcgggtgcttccaatttcaggtggttctggattttaagagtgagatgaagggacccaccttcagacttcctataggcaacttaagtgactatctacatctttcagtctctgaaatgttcttgagaggaatattaatatagttctttatgacttatttggtaaattactggttacttggaagatacgatataattcctcaaataatgtctcctatgaacatttcatctgcacatctgggcaaaaagagttaagagagcaggcttgagtttgccatctttaaaatggcctgcttacaagactggctcttggctgatgtctggggaatttggatttggggacagttcccagcatttccaaaactggcaagagtggttcattgtgcctcaactgtttgtgcaaacaatatagtttatgctaaacacttgttttccctctgagagtttggaattttgctacatgatagccagagggtagctatgtgatcaacccccagtaaaaatcatgaatactgagtctgtaatgagctttcctggtagataatatttaacatgttatagctcacttccgagttgagggtattaagcgcatactgtgtgactccaccgggaaaggactctgggacaccgcaccgggtttccgcgggacttcacaccatgtgccttttgcctttgctgatgctctgtatgctttcactgtaatgaatcttactcatgggtaagattcattcatatgctgagtcatgtgagtcttactagtcaataattgaacctgggagtgacttggggaccctcaacacagtgtcctaaggtatctccatgagaaacctggggagaaggagaaatgtaactgccttgttatccttctctttgtgcagtagtagcagtagtacaataaatacaaccatcaccatttcttaagcaccttctatgtgtcagcttcatccaaggcagttcttattttctacccctgacaataaacacggttaaaaggcatttaccctaagtggaagtagaattagaaatccaggatcagaattcaaatatatcttacctcaaaacccatgtactttctaaaataacacattcattccttctccttcttatgtaacaactatttaatgaaaagcacctcatttttatatggcagtttgtttaattttcaatattcaaactgaaacagaactactattctgttgaaattcttaactgttctgtgttctatatatacaccgactagccaatatgggaaattagtgactacaaaaagaaagaaatccagtcagtgtgtacttcatgctttttgcacaggacaaaagggataattctgagtttcgaaaccttaggattagatgagatattaaatgtaaaataattagcacatggcatgaacagatgcttaataagtattagtcccaattttcttatgggttacaaattattttggcaattaaatcaatgccttaacatccttgtccccattcccctatgtactgttttagatttacctactaaaactagatgagcacaaagtggtcttgacaaatacatgtagaactcaactgatcctagttgctaccagattgacaagtatttcaatccaagacttattcactaaatttctgccatatgccaggaatgtgtcagataatcaggaaacaaaggtgaacccccatttacaatctagtgtccgcagtccagtggaagaaatgcaggttagttataggtgacatggagaagggaaattgaaaccaactaaattgccttattcggaacatgcatattctttcagtttcatctatgctattctaactagaaacttaatgaaaataagttactattgcacatattttcatgttggacttctcctgtaagtatatctattgataccagtgagaaaaaaataactgatactttaacaataaagagcctctgataattctgttatgggcaacaaaatatttgttttaaaaagctgacttaaaaaaatcagtgtaactgattgaacttcaagtggcatgtatcacattacgaagactttacactatactacttcctaaaatataacattctaatccaggctaataactatttgtaatttttttctcatattattaaaatgagaataattttaaggatagttcatttctgtcagcagtacatggaagcccctcaacccccgacaatttctccaccacagaagttttatggaatttggcagccatgcatgtatgctataagaatttatttcattatgttttcccctcaggccattgtatttctttgaaatacattcaatttctttgaaattggtatttttgaaacagtttattccttttttccctgcatccatcactttctgtactgttaagatatcaattactccatgaagtctcatgcatatctcctgatgaaaacaatcaacttattcttactttgtaagggatagatcaagtctcaacttttttcaagaaggcttcttgactattttaaaccactataagctctcattacccttatcctctttagtaactaaattatttaccatgaactttttggtaactaaagaaaccattaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaaccattaactcttatcctgtttcttatattataaatatttactttttgagatttgatgatccttaaggagagcaatgtcatcatgtgtttctgtataccaacacaacttagcaacaccaaggagtcaaaaaactatatttttgaatgactcctccctaactcattctatgaggccagtatcatcctgataccaaaacctggcagagatacaacaaaaaaagaaatcttcaagccaatatctttgatgaacattgatgcaagcacatgtaccctagaacttaaagtataataaaaaatatatatatattaaaaaaaatcctcaacaaaatactggcaagctgaatctaacagcccatcaaaaagagatgtacaacattaaaaaatacaaagaattgccaattacttaatctttttgaggttttctgaaacttttgcttaacattctttcctgacatacttttgacaatttttcatcttttcagtatcggttatcgtgacatattggtatcttctactatactatgaaagcaatctggtctcacagtccttactcttacccgttttgttatattattctaagatattttgtttccaaaatcatagttagacatgattgtcactttttcattcaacaaatatttattgaacaactgataagtgaaagagtcttgtgctaggcagtatgaggaatataaataggaagggaaacacagattcttccctaagacatttataatcaaagagcctagggatataaatatctaatacacaggaagaaagtgctaaaaattacaaaagactacattttatcaaatttaacaagagataaagtttattttcagcttggatatttagggaagatacaaggaatagataaaatttggatatatatacagagatggaagtctagggcatttcaaaagagaactgaaatcaagttgatccaaatcattaatctttgaacaaatgtttattgaatatatattatgtgccaggtactgtatataagatatagtccttgagtttatggagcttttactctatttcctaaatatcttttataactttccccttcattgctgcccaagttgaagcatttcgctgtcatttctccttaatattactgcaataactttgttattggtctccctttatctccaattcatcttttatcttgcagctgcaagatatttctaactggcaatatgactgtttcaaaatattactataaattcaatgatctccttacgctacaggatacaatgttaatgactgtagatggcatatatacagggttcctcattatttcatcattgtctactccttgttcagaccctttctttcctccctcctcccttttactgtatgatccagtggtataaaactaactgttattcagtatatattggttctctcatgattctcagcctctgtacatgttctgttacctagagtgatgcctaaggccttcttacatttttaggaaaactcctccacattattcaaggtcctgctcaagagctgactcttcttcaaagccctcccctggttatcccacaaaaaaaatgctgtgctcttttattatagccataaaatattgtatcataatggatttttacttgtctctcacgaacacataaaaagcaagaattttttttaactatttatctgtaacacctaacggttatgtctgacaaacaattggtatccaaacaatatttgtggaatagtgacagactcaaaaagccagtggattaaggttgtaaagaatggatgcaaaacatattacggatgtagaatttataaaagtaactcactgaaagtaagtacaaaggaaaagagggaatataagaaaaaaatactgagctttcatcacctggtaactggagagtgtggtaccaattacagaaaatactaagaggagggggtgaattgaattttagaagaaaggtgataagtgtgggtttgaacccagtaagtattaggcttgaaaacctgaaaacagcctcaaacaatggcataaataagttttaactttactaaaaactacagatcaggggaagtgttcagatttaacttcatctgtcattgatttcacaaacagaagttacccttcatgatttagtttttgcttcacgaatcatggcgcttaaaggacttaaggtccagaagggaaaagacatattcaaataaaaaatggcaagaagtggtaatagaaacatgtataaaatacagaggatacttgatgtgaagtatagaagtgatactggcattgacttgtagaaaaaaaagtatttgtaaactcaagaagttgggtgggacattacaggcaactagtagaagccaggtgagctgtgactcattgtgccttacctacctccagctatcatgaactgcttacagtacagttctgcaaacgctccaggtcatttcatgccttcatgttttattctcatgctgttgttcccattgaaatgtccttccttattccgactgcttcacaagaatctgtcgcattttcagacttagattaagcacactaatgtcctctgaatatacagacagtagcaaataaattttaaaaattacctttcatttcttaatttatcatagttcaacatacacatagtgtcaatgtacaaaaataaggcatgtggtcactgctgtagaagagctttctgtatggatagttcaagtaaaaaagttactgtgatatcaaacaatgaatgctaagaaccgtaatagtgtagatgaaagtgctgaaaaggctaaagtaggaagaaacggaatctaactgggcgtggagattagaaaagacttcatggttgagaaggtaatttaagatggatcttgaaagttgatgcttggtggacaatgagggtgggaaagcgaaggtctttagaggtgacagaaacagcctgaaacaaaggcataaataagtgagtgatgtttaatgaatattgagtggccagatcatagggagtaagttggaaagtgtaggaataacaactgtaaaggtaggtgaggaatatattgtgggtgatcttaaaagtcagaataaaaattttttacaatttatattcttaaagcctctacagactcattttcccccttataatctactatgtcccattcccctagcattttttggaggcatttatatcatcttggtcttttctgattttagtgacagcaaattgattttatcaacataccagaaaaacatagattccaaaactcattaatcagaaaagtgctgagcataacaaccttgtatctcagctgttactatttttccatttttaactgaaaatgaaaaggttatatacttacaaaaagttttctacaaaacacaaaggtggctatatttgtggttaaaataaaatccagatttcaatcaattatttttcttacagtcaaaagtagagcattcatatatttgtggtcaaaaaatgcaatgctgctcccctcatcgggctgcttagtacaattaatgaaaaaagagacatttcataaacagaagatagagtccaaattcaaaatatctcaacctgataggaaatataagtttaatgacattctctgataactttttcaaaataataaaatgaaaagtcactaaaacttaaaatgtagaaatgctttgatctgtaaagcaagacttcaaaaaacatgtaaagtgttcagaaaaatgtttctagtgaacatgcgcacataaagaacagatttcactcctcttgaaaatattttctggtaagattcttaagtgtttgttaaggaaaaaaaatgatacattccataaaagtattttagacatacatgtggtgtacatgtaaatgcaaattaattcattatgttcacactacacaaaataaatatgtgagagcaacacaatttgtctgctaatttgaatctgttttctgatttgagagtaagagttgaagaaatcatcacatttgtgtttaatgtttcttaatgataaaagacaaattaggcagaatcacatatggtagattcatttaacaaaatcttgtacatctcaaataaagtataaccttccaggacaggaaagggcaaactacagcccgtaggctacctcctgccagctgtctgtttttgtaaataaagttactgggaacagagccaggctcaatcatttatgtattctcgatggctgctttcatactacaacagttgagcagctatgataaagaccgtatggcctgaaagtctaaaatatatactccctggccctttataaaaaagtttcctgaccactattctataatgtttgtaacttttaagttttaaaatttagtatattgattacatagtccttaatatttttttagaaaaatcagaaccacaatgatttttcactatttttactctcagattataattcagccatcaccttctctaagagtggtattgtcaacaggtggcccaaagcaatgcctttacctttgccccttccattatttccatcagtccttcccattctttaataccaacaagcaatgtattctccatttgatatatcctgaccataaaagtatcattagaaccctttgctatttttactgatttgtaaataaaaataagacagagcactactaataaatgcaaacagtatagtttttatgcaaactagcttcaggggaagtcccttgacagcctcttccaaccaaaatgccacccctcgaccccttctatatagaaagttagagctgccatttcctcgaaagttgtgattaacactttataatatccctacctaagagaatagtaacatgtttttagcaaaataaagccagagtttctctatcaacacctatgtccttatgatagctgccaaaacaatttttacttctttttcttagagtatcttatgaaagaggactaatgttttggcaaaattatgtgtataattcttttctcattttctagatcgtatactacttaaagatcaagtcttactttactgttatctctagcacacattaagtgttcagtaagtgtcttctgaatgctagaataaataaatgagaaaaatactagtttttaactgtatctttcttttgtttggctataaaaatcacagtatccttctaaagcacagaaacataagtacacgatgaagaaaaacatgagacacacatatttgtagacaatgaatttacttcaagtcacagaataatgtttaaccctattaggattctaaatattaatgtcacaggcacatatacagaattacattgaatgtgatttttaaaaaataatcattaggagtaaatccttaaaaatcagaggttattaaaaaatattatttctatcaattctaaaacaagtaaggtgatcaagtttacatttccttagtctgaaggctaatgggctaattgcctctgggcagtaagcatgttaaatactcacatctgaaaaagactgatgctattggaaaagcaaagttccattttaatatctcttttatttttattattttgaagaagtaatttattgtttttacaatttgggcaatctgaaaaattttattagactaagaagggtactctcttgtttattactctttaatatggcacgtataataactagcttgttttctacaccagtacatgaatgctaggtctaattctttttcagtttcaaaaatgataaatatcaaatacatgatcctaagacataataattttacatgtccgtggtttttcagaatagcttctcaaaccataatatggtacatgtggccccatgacctctaacttcatgcagtaataacaggattatacttattcattagaaagacaattgaaaatcttcagctaattgctaagaggaagcaggatgatggggagaagttaaagatatctccttatcagtcccagctctgctgctatatgacctgactttggacaagtttcttgacttctctgaaacataagtttccttttgtataaaataggaataataatcattattttccagggtgtctatgaggattaaataatataatatatgcaaagtatctggcatattatcagttctcaataaatggtagctatttttttatcatattcaggtaaacatcctcctgatgatgaaatgtatcatggatatacatttcatataaatttccattgcctgagaaaaattactaccccctattacatagaaggtatacaacagctttattgctgttttatagatacgagtagcctaaaaacaggaggggtcgatgacattctttaagataaaggcactgaaactgcaaaggccctagctaggcatagttgtagagttatactacagttcttcctgcatggctgaatggtaccaccagtatctgggtctttccctcaaggaaatatgacttcttatgatttaggtaggtcccactaaaactagcagtctcctattgatacggaagtgcagggtagggaagggctgggtaactggtgagggctccaccctcaggcctgtgcctaggatggcccaccatgctccccatcctgtgccgctataagccggatacagacacagacacaaatgggtggatgataagagaagcagaataacacaacaacagacaccagcaggccatctacggggagaccacatggaattcagttggtgtagttgggagaaaagtccagccactgggtggcctgactccaggggaagaccaccttcccattccatccccttttggctccccatctggcttgctgagaacaacctccatcactcagtaaaaccttgcacccatcctccaagcccacatgtgatctgatttttccaggacaccagggcaagaacccgggatacagaaagccctctgtctttgcgataaggcagagcatctaattgagctgattaacacaagccgcctgcagacggcaaagctgaaagagcacactgtaacacatgcccactggggctttgggagctgtaaacactcaaccctagatgctgccgtgggattggagccccaaaatgctacgcactacctgcctgtctgcatgcttcccctaggggtttgacagcgggacaccaaagaaatgagccacacccctattgcacaccctgcaggggggataagggaagttttcccatttcattattaatgaaagaaaaaattggaaataaaataaaaccaacatgtatcaagctaatttcatggtaattctaccagagggtagcaaaaccaatcactgtatcaaatgaggttttgtgctgagcacttctacgatatttttttctggctctttcaaagtctttcctatttctatcacaaatacattaagttatattttcataattctcagaggcaaataacatttgacaatatttttaaaagtaaattgccagcttggcttaagatattacagagcaaaattttattttaccctttttcacatctcttaaacattaattctcaaggatgcacttcaagtttaaaaacaggacaaattgatgattacctgatgcagaaaagagagacttggaacggaagataaaaattttggatttgaaatccaggtctgctacttactcactgtatgaatttggatacattacataacttcaataaatttcagtttcctcatttatagaatgcaatatgaaaacttatttcataagagttgtttaaagactaaatgaaattaacaggccttcaataaatatatttatttctttttatttcctccactgactccacctctttttgcttctgaatgaattcgttataacccagctcagaatcagtcatgagagggtttatgattataaaggttttgtaatgagaaacagagtatctgattttgaggattatccatgcctttctcttcttcctctctgctcatcggtcatttattatacattagcacaccagacaggaggcagaaaaacagagaggacacagtagatttctcatgaaatcttactttgttcaccaaagtctataagtaaaggaataattgtggtaaatcaaataagttgggttatgttttaagagatgaaacaatgtggccagactactggacaatcatctgaaaatcttcacgtggggcagaaatgtggcaactgaaacttaatgtaatcaaggaaactgtgaaaaaataaatccacattttacatataaaatatgagaccagaaaatgaccctagaagtccccaccgattatttgccaaagacatcctcagtttcctgttacaggtaaaaggcttgcttgatttaagtatcatcaacagtaaagaaaacataataggagtcattatcctactcatgaagaaagctgtgaagtcactgcctctaaaatactttagttttgtttgctccaacatcagaaagacataatgaaactagaaaacggccagagaaacttagaaccaacccaaatgcccatcaatgatagactggataaagaaaatgtgacgcatatacaccacagaatactatgcagccataaaaaagaatgagttcatgtcgtaccatcattctcagcaaactaacagaggaacagaaaaccaaacactgcatgttctcacacataagtgggagttgaacaatgagaacacatggacaccacgaggggaacatcacacaccagggcctgtcaggggatggggtgcaaggggagggagagcatgaggacaaatacctaatgcatgcagggtttaaaaccgagatgacgggttgatgggtgcagcaaaccaccatggcacatgtatacctatgtaacaaacctgcgcattttgcacatgtatcccagaacttaaagtataatttaataaataaataaataaaataaaagggccagagaaaagaagtcaaatttgcaggtgagaggaagactagaaacatcaacattcttagaaagaagtcatggattcttagaattggaattatcctgagacagtctatatgccatttccttgtgcttccagaatattcctgataaatcctaaatagtttagttatcaaaggcctaattgcacactggagactgactaggatcctcccctgatttgcagcctacctccaatctgttatctcaaatatcttccaaatatatccacttctctttatctccactggtctaaatcatctttctcattcatatagactactacagaagcatcctcattggttatcctcttctacttctgctctttacagccatgcttcccaatccattgcaataagagtgatcttaaacctcaaactaaatcataacattggcttacttagcatacctttagcgattgttcattgaccttacattcaagtgcaaagtaataaacatggtcctaaatgattggctcctgcctccttcactagtatcatctcacataccttctccctttgctcatcaaagcttatccacaccaactttatttcagttcctcaaaagagctaccatcacatataacaataacctccaccacaacagctaacatttatcaagtttttactacatgactggcattgtgataagtgctttatgtgcattatcacttttaatcctcataagaaaatctataaggtagttattttcatcgttttactgctgaaaaaaaaacaaatatttagaaacattaagtattttttccatagcaaggtaggtggcaaagatggaaattatgttatattgcatattccagggaagttttttccccaccccttccctggctaacttatatcattctttatgattactacttatatgtcatttcctcaaaacagccttctctcatctattgatctaaaattggcacccttgtcatagtcccttgtactattttttatagaatgcatcacagtttacatatttctttctgtgactatttaatatctgtcaaacctccaatagactgtaaattccatgaaggtagggaccatatgtttaaaaatgtgcctgctataatcaataaatatctgcctaataaatgattgaaaaaagacatcaaaccttccaataataaggtgttggatcactctatggaagaacctatttgagtgttagaaattctattaaaatattcttgcctacattaaaccaaaagctgttcccttataatgtctatccactgatcctaatattggtcttttggccaatagtgaaaaagaacatgtttttttctttacagttcttcgaatactttcagcctagaaagtttaagacagagaggactggtaattatggttagataattctagatttacttctaaacatctgaatgctagaatatggaagatgagagggcatcttttgaaattagagactcatctggggcacatttatggaaattaagtctttgtatactataaataattgcaagaggtagacatgaaatataggtgggactgctgtgcttcacacactctatcacaaattgaattctaactggtataaatctagaaacaaacaaacctggaggagggccagttaaaggcaattaatgactatacaaaaagattgaacaaagtaaaaatcagctactacaattacaagatagatgtcatgaagtgcaaccatatcttctcctatctctcaagaattttcttggcaacagaactctggattagatgaactatatttctaagattttgaaattagaaagacaaaatgaaagccagaattactgagagccaaaaataaaaatattctttagacattttatatatttgaataaacttgatataggcagtaattttttaaagaaggcttcatgtgccatccttaacaagaaagatagaatctcaaagttggaaaggtctttttgtctaataacttatcagatgcttaaagactctctacaacatttatatgagatagctattgaactaatattaaaatatccaagcatggcataatgcaaagatttggattttgagtttggagctttgggtttaaatctcagttcagtaatttattagctatgtaactttgaactggttactcaatgtgctccagattcctaattttaaaaccagaataacaaaatgtatcttttaaagctgtttgagaattaaatggaataccgtaatatgaaatgtcacttggcactatacctagtacatagcaaatgttcaataaatgttattttccctccagtgacaaaaatctactacctgccaagatagtctgtttcctctttggaaagcactggcagtgggttcttatactatgtggaattagtccaaaactattaagtaaataacacttaaaagtttaatatgtaagatattactttaagaaaatatgttcttcattagcattttaacttcggatgccaactttatatatatttcttaagcaatttgtcactcagaaatggcagaatttgagtaatcttagagaaatatgttacaatcatatttgactagaagcctttaataacctaattcatacaaatacttccttgaaactttcccagaaaaagcaagaacaaaaagttctccttctagtgactcaggattaattaggtatggcaattatcttttaggactacacagatactcttcctatttttattaacaattaataacaaaaaatgggcatcagaaatgttttgttgttttgtcacaagaccaagatttataattaattatttaagcctataaaacaaccatatagaagaaaattttttaagtcataagaaataatattatctattttgtgacaattaatttagcacactctgtaaacgaattcactttcctggtgttaatttaattttccactttatgtatgttatgtaagttcatttgttagagaatattttggctggctttcttcattgtaaagaataaaattacttctaacaaatctgattcaaatacaacatgaagcctgttcttccacaataatattaatttgaacaactcaaactttatttgaggaacacaattacactttccagctcaatatctcttaatttacctcaacttttcaaacctaaagaaaaactatcttcaagctattaaattattgtataatttaataagctttttaataatgaaaaatggctgagtgcagtggctcacacctgtaatcccagcactttgggaagctgaggcgggtggattacttcaggccaggagttcgagactagcctggttgacatggggaaactccatctctactaaaaatacaaaaattagctgggtgtggtggcacacacctgtaattccagctatcccgggaggctgaggcaggagaatcgcttgaacccgggaggcagaggatgcagtgagccaagatcatgccactgtgctccagcttgggtgacagagcaagactccatctcaataaataaataaataaataaataaataaataaataaataaataaaatagtgaaaaatgttaaggtcaaattagattgaagctatcagaataaaattaaaaaccaaatattagaaacaatgtttctgaggtcacaaatatactttatattggatgaaaatgtcatcaattgtgttttctctcttttctcttttgtacaataggttttatttgccagcagaaacatcacaagtaagtttaaatttgtagtggataagaattattctgattccgagtaacttgactatagcaaacgtaatcatggctaatatgattcctaaaaatgcttacagctgattaaaaaataagagcataaaataagcttactgtttcaccaatttttccaatatttccttgatctcctacttctccctgtcaaaaaagaatataaagttgcaaaaacagttatttttcaaactagattattcatgacagtttcaattttcctttttaatgtaattatctagtcataacctagaaaaaggcaaaggaaatttcagttacttaaaactttgttataagtggagcaaaccaccatggcacatgtttacctatataacaaatctacacatcctgcacatgtaccccagaacttaaaataaaaatttttaaaaactctgttatagtatttctatgaaatgtggcctaccctctattttcattcaaatagtaacgtatcagtctgttctcacactgctataaagaactacctgagactgggtaatttatgaagaaaagaggtttaattaactcacagttccacggtttaacaccaagcatgactgggaggcctcaggaagcttacaatcatgatggaaggtaaaggggaagcaagcacaacttcacatgttggagcaggagagagtgagagcaaagggtgaagtgccacacacgtttaaactgtcagatctcgtgagaactcactcgctatcccaagaatagcaaggcggaaataagccccaatgagccaatcgcttcccactaggtccctcctccagtttgacatgagagttgggcagggacacaaatccaaaccatatcaggtaataatctattttcttaaaaaatattctcctattcgtgacttttaatcacttttatcaataaaatttttaaaaataaaatctttattgaggtgtactctgtaaaaggcagagtagtaagcactgtgaaagatattaagaagaataaaattaaagtctttcccacagggatgttctatttgctcaaatagaacagaatacatgccacaggttaagtactaaaggaggtcttaggagcaggcaccctgtgaactggagcagctagagctggcatcactggagaagtaatgcatgttcataacctctgaaacaaaattttgcaatccataaatctctgaaaactcagttttccacaactcatttggtggcaaacttgacctaacttggattgatttggcagtaaagcttattttgttctgaataaggccatttatagtcttgatttattccaattaatctaaacgtccttacatttcactacagaaatattaatatatctaattatggtatgctgtcccacacccttctggtagtggtaaataaaatacagcatatgcaacatattacttttcaaaaatccaaacattaatgatttcaaataatggattatgaaactgtaagtggggccctgaaaaatatgtgatacttaacactggtaatgagaaagcgtcatttttagtggtgaggaatggcatcagcaaaggtatagattaacgaaaggtaaaagattaagttcaaagtacaacagagactgactctaagagcaatatacatttagtgtacagaaacagattaaatatgttatgtctaaaagtaatcaattactgtctaaacagtaataattatattccagtgtagaacagtaagatgttaagatactgaaaaatattgtagccaataatgacatgtggctactgaatatttgaaataggctggtctgaattgaaatgtgatgtaagtataaaaaatacatcagacttcaaagactttctacaaaacaagaatagaaaacatctcattaataatttcaatattgattacatgttgaaaggatataatatttggatatcttgagttaaataaaatatactattaaattaattttacttctttcttttcactatctaatgtggctcatatttgcagttcatgttgcatttctattgaatagtggtgattttaagcactgaaacctaatattcatcatgagtgatcactgaaataaactttcaaagtctacacaaattttcttttcagtttctgtatgtatttagataaatagtaaagaatgaagcacagcagtaggttttaataactaattttaacaggcagttcattagacagcatttatggaaaatttatggaagaataatatatgaattattggttttctagtatttttccctccttacccataagttacccttcttaaattccaaatttgtgctacttagttttaagggaggtttgtgttaatagtcaaaaagcaaaagttgtttgcagattacttgcattcttactttagttttcagaatctgaaggtaagaagttacttgtctttgacgacaatgaaagagagagagagaagctatttccccaggcctagaaagaaaacacagatctagggttctatgaagagtgtgtcccttaagcaactcccccaggcagtgccaggtccgagttaatagctacatgatgtattgaaacgcaaatttcagtgacagctagggaggaatgaacattacaaaatttcctgtgtttactaggtaacacagaagccacctagattttggtgtgattctagggagagaaagtatatacataaatgagattccgtttcttgccagtttcactggatggtagctcacagttggatttcctagcgctatttggcagtctagtaaaggagaattgttaatcccaggcaaggagaattgattaagccttttgtttgtaaatactacaatcctatttttcagaggacttttatatgtaacttgagaaagagtcaggtacacatattctgccccaggataactttagcctcatacatactgatatattaaaacatacttcagctcatatttctttatcaagcttgaaaagtgttgtttagcttttcgttaggttccagcatcataaaaatgatacatttaatacaaaaaaatagcttcaggaaacgtagtaataatgctgtgactatgtcaattcatagttaaattttcaatttgcaaaacttaccaattcttataagctagtttctttcaggtctcaattctgtatgtaataaaccattgcattactttatatttgttggtgttataaaaattatccaagaccttggaaataaagtaaatagtgagagatatatctttttaatatcataaagtgatgaaggttacccagtgattatctagtgaatattacttagactcactgtttactagtgattaaaagatccagacttagtaatgttatagaaacttgcacatttctacccagtagaattgaaaaccccagcagttatggtttattgccctgtatgtaacacacaaatcttatcctaacatttctttattaaatcacatacatagatatagatacagatacagacataatcacagatacacagattgagcatccaaaatctgaagatctgaaatcataaatgttccaaaatctgaaactttttgagtatcagcatgacactgaaaggaaatgctcattggagcattttgaatttcagatttttggatttgggattcttaacttgtaagcatgtataatgcaaatatttaaaactccaaaaaaattggaactctgaaacacttctggtcccatgcatttcagataggggatactcaacctgcatataaatagatacagatataaagatatagattctcagttgctctttgtaacagttttaacatctcactggttctttttaagttgatgtgttcatttcacatttgtatgaaagtcataattttatctttctgaaaattatattttaaaactgataataaagtcagttgctttacctttaagccttctggtcctggttcacctgcataccccttttgacctggttttccctagaagagaacagcataaaagaagaaagtatatatgtttagtcattctcatttttgaaagtttcctaagatatatgaaatttagactattcttataaatttaaatactttaaaattatttgataaatgtatttcatcatactcatttgccattcattctacaaatatccaactgtctactatgtgccatgaacggttctagatgcagaggatcgaggactgcactgaacatacctgccctcatagagcttgtattttagtgagaataacaatgttttaaaaaataagtaaaatatatagtatgttaggcagtggtaatatgtaaggtaacaaatcaagcagggaagggatatataaactgttgtgggagttttattgaaagtgtttgtaagattccaggaaagaagccctcaccgaaaagttctttgcagattacttgtattcttactgtagttttccgagagtctgaaggtaagaagtgacttgtctttgatgacaatgagagagagagagagagaagctatttcctcaggactagggagagaagagagatcccaggattctgtgaagagtgtgacccttgacccctcaaccaacttccccagagagtgccatttcctgggggagttggcagtttggtggcatttgagtaaagacctaaagaaagggacaagttaaatggatatctgaaggaaaagtgttccaggcagaggaaaagggcctgtgcacaggcactacagctaaaatgtgtgtagtatgttggaggaaccaggagaagctgaagaattgagagaagaccagtaaagtgatgaggtcaaaggaaatgggggatgagaagtcaggtcatgtagggccttgcaggttgcagttaggactttgacttttaactgagtgagataggaagcctcagacaactttaaggagaaaactgatgagatctaagttttaacaggatcactttgattccagggtagaagaagagagtccaaataagcgtctagtacaataatccaagtgagagatgatggggatgtgaatcagggtggtagcagagtggtaagattctggatataatgtgaaggtagagcttccaggaactgctggcgggtcatgtgtgaaacgtgggagaaagagaagactcaaaaatgaatctcaggtttttaatgtaagagtagcagaccaaatgaaatgaagaagactgaaaacaggtttggagggtaaataagaagctaagttttggacatgttagtttgatatgcttgttagacatctaaatggagagatcttgtggtagttatttatacaagtccagaatttaactggatcagttaaattctttctaatcagtagaaagatctgacaggaagaaataatcttagaaaccaccagcattttcattttgatggtatttaaagtcctagggtggatgacctcatttagccagtgagtatagatagaaatgagaaatccacaggccaatctttggggtactccaaaacttagaatttgaagaaattagaaaaatatttaatttgatgccagaaagtgaggaggaaaatcatggaagtaaataaattgtttctaggaggagagagtgatcttgtcaaattctgaaaaatagaaatattgagtaataagaggactttgaggattgagaaatgataattggatccagcaatacagaaaccactgatcgtatttatcagatcatttgtattgtagtggtgggaacaaatgtggtttaagcagatagagggaagagaaaaactgaaagagcatgtatagacaacacttttgaggaattttactgaaaagggaaagaaaaaatagggtaacacctgggagggaaactgacaccaaaaaagttttgttttgtttttaagctagaagaataacagcagctttatatgctgataggaatgattctgtatagagaaaagaatatgtaggagagacagagggaattgttggaccagttatcttgagtagtcaaaaggacagggtatgtagtaaacaagtggaagttttccttagcttgaaaaatggcctgttcatccacaacaacaggaaagaaagcagagtatagataaaagaaggtgggtagatgcaatgtcagaaaactgtaagttctcttctggttacttcaatcttctcagggaagtaggatgcaaggcaaaggctaagaataaggatgagagataactgaaaggagtttgaagaaacagaaagtataaagtaataatttagaaaagcaaaagaataaataggcttgaagatagaattcagaatgtaatcaaaggaataattataatgttttaagcaggatgaggaatttgggatcataaaggagacaagacacaatggaaaggcagcagaatcaatgcactgacattcctattggggctattagattggataataagagagaatgtattagaaagaaagatggtggttggggaatgagaagttcaaaattgaaaatgagaggttgctatcactggtaatgacaaagtaaagggtatgactgtagcagtgagtagctgaaaagaatagaggataagatcactgggggagagcaagtccacagacgaggtagcagggtatggtttcaggatgaaactggtccacctcagaagatcatcaggcattagattctcataaagatcacgcaacctagatcccttgcttgcacagttcacaatagggtttgcgctcctatgagaatctaatgctgctgctcatctgacaggaggtgaagctcaggcagttagatggtcaatacttagtgtcaacttgattggattgaaggatacaaagtattgatcctgggtgtgtctgtgagagtgttgccaaaagagattaacatttgagtcagtgggctggggaaggcagatccactcttaatctggtgggcacaatctaataagctgccagtgaatataaagcaggcagaaacatgtgaaaaggagagactgccctagcctcctagcctacatctttctcccatgctggatgtttctctgccttagatcattggactccaaattctttagttttgggacttagactggttctccttgctcctcagcttgcagacagcctattgtgggaacttgtgatcgtgtaagttaatacttaataaactcccctttatatatatcctattagttctgtccctctagagaacctagactaatacaagtggtaacgctcactcccagtccatggcctgggggttggggacccctgctatattggattttattgctgttgtcaattaagacatgctcttatattttttcttcttaaagtgaaacagaacaactctctggctcccattctgtttttactacacataaaagctttagccacttacaactatatttaagacttctagtcaaaacattctaatttttgcttttgactgctctaaattatcgaatcatttcctaacaagcaaaaagcaaagcaaagaactgaaaaccatcctattattattaaatatcaattgttctctacttaatttagatatacagaacaagaaatatagttaagaacctgaattattagattttttctatgatatttataaaaccaattctatttttatttccactggttggtaagagccttaatgagtcattcctttcatctttaataatactctttcaagcactgtgtagtacattaagatagagttatacatatttacattatggaaagaatctcactggaatctggtatcagcacattttcaaagtctttgaaatcaagcatttcagaatatcagtaacagaatcataacttcttgtcctacttaaattctatcatattgtattgattttgagagtgttatacttgaacatctaatactaaaatcttattttcacatctaaaaataggaacgatatcttgcaaagttgttttcaggattaaagatgattcatatacttatagcaatactaggtcccaaattgatattcaacaaatagcaacaacaataataattaatattaagactgtgtagaccagagttgaatatggttctcctgttttcgaaggaagtaaattttaaataagatcaattttattgggctcaaataccagtttttctgttaaataattctcacgaaaaataaaatgaaaactcttttttttcccccaatgggatatagcaatatatgtgctagtaaggtaaaaatgtgaaagaaataatcacagtctttttaaacgtaaaagcattttaagaaccagtactttggccaggcatggtggctcactcctgtaatcccagcactttgggaggccgaggtgggtggatcacctgaggccaggagttcaagaccagcctgatcaacatggtaaaaccccatctctactaaaaatacaaaaattagcagggcatggtggcacatgcctgtaattctagctactcgggaggctgaggcaggagaattgcttgaacccaggaggtggaggttgcagtgagtcaagatcacgccactgcactccagcctggatgacagagtgagactctgtctcaaaaaaaaaaaaaaaaaaaaaaaaaaaaaaaggaagaaccagtactttatgatgttgtcaagaaaagaaatgagatgtatttcatgtgagtctaatgcctcttaaaataaatgtaacacatataccttaattatttcataaggtaaactttgatcatgtataccaaaaatgtttaaataattcatttctagaacttgaaaacaaataattaacatattacccatggtattatctgatgaaaaaattggcagaaaatacatcttattagccttccataattttactaacacatttagaaaacaggaaatctcagaatattactaaaatggctaaagtatttagcttcctattacattttgagaaatttataaataatttgcacaaattactaagtctacagaccactgaaataacaagtaactatgtagtaggcataacatcattcaaaatatatttgggacttccagttattggcctattttattttggggcattttatgactttaatttgttttcatttttgtcctttactataatgtaaaatgttatgatgttaaaaacatttatagaacagctattttcaagaaaagcacttatggaaaattatttatatgatacctactcttggccccagttccccaaaggctccaattggtccttcttctcccttaaaaaaaaaaaaagtcagaacatattatggcctaaaatgagtatttaaaaatgtaaactcttattttctctatttattctaaaatgtgaagctcattctgagatgtgatgaaaataatgctgttattttcttgtactttgaactccatcaccccacaacactttagtttttttgtgtgaacctggtgcattcgtgtagggaccaaaaactatatgggtggatagagactgaagatgaacatagaaaaaaattaaaagcttttattcataattctctaaaagaaaaaaaggcagtaagtgtttttactccatttatagacatatttactaaatatactgatttacctttaaaaaatagatgattgttttctgaataatacatacagacctccctagaatcatatagtatatgttatttatttggtaaatattttgctcaattcacaattcaattaaaatataatttattggttcaaaaatattaagtagtcacaaatagtaaatataaattctagtatatatgagtgagattctgggttcagattcttcagacattccattggagaccactaacataaatcatttaatgaattcagaacactgtaaaatgattcttaattctattccataactggcaaaataaagtgttaacttgaaggctgggtgtagtggcttatacctgtaatcccagcactctgggacatttaggtgggaggactgcttgaggccagaagttcggccagcctgggtaacatagcaaaactgtgtctttacaaaaaatacaaaaattagccaggcatggtggtgcacctgtagtcccagctacttgggagggtgaggcaggaggattgctggagcccaggaggtcgaggctgcagtgagccaagatagcaccactgcactccatcctgggcaagagaccaagactctgtctaaatatataaataaaatggtaactggaaatctgatggtgtttaagcaaaaactgaaggcccacaataaataaaaagggaaaattttaactaaaaaccttgctgaagctgactggatatcacttcttccatacctgagttcctttgagaccaggaggtccaggaggtcctctatttccaaggagtccctataaaagcaatataaatgcacacaatagaaattttagatcaactgacattttgataaatcagcattaatgtggagatggacaatactctttgaaaccattcatttcccattaagaagtcctcaaaatgggttgcagtatgggcaaacagaaaactactgggcatctaaaaatataggataaacttatttttaaacagtaagttaatattcaaataatctgctcagtattttattcttcaacctccagacaccttttcagaaaaagtatttctaaaacggaagcaatgggtccaaatgttaaactgataagagtacagtaaaccgaatagagtgttcacaaagtctgaaaacagatggaggaaacaaacagtgttttaatatctattaagagatctgcagagtctggaactcagtattcgttagctgaagaatgcattagttcttcattactcattagttgaagaatattcttcaacttatttccctttttgatacaagatgataaaaagagaagaggaatttgcagaagaaagtgagtgtgaatttgaatagaaatttcaatactaaaaaagtattttgttaaacaaaatacatgttgttaaaaatcgattgctctctgaatgaaaactctttcaaagttaattatttttaaaaagtcttaaatcagaaaacactatacaacatctattcaacatggcaacattttcttaataagttctgttctcctaattattcaagatgccagcaaagttctaagtctctttttagaattatagtttgaatgattgcttttagtcattttataaccattaagaagttttatctaatttttaactgtactgacataatttttaaataactataccaaagagcaaatctactcaggtcacttttatcttgttctgaaatgcaacagagtgacaaactacatgggaatctttccttcatgttatattttgctctatactttctatactttaacacaataaaaaaaaactctgtcagtttaaaagtctataatatagtattgtaagcttattacataaacagcaccattcaagaaactgtattactttagacaataacctaactttttaatgaagctttcttatttttaaaagtaagatatggattagattatggaaatgggcacattgtgtcttatgccagtccaatgtatgttaatcctttttcaggcaaaagcaccctaattttccttaaggaaaaactctcttcacttttagtgcacgttgtttgaggggaggtgactccaccttcgactgtaactgtgaacatgtgacagacatctaagtcagtcagtatattgtgcatccccagaaaaaatgactggtccaggaatgagtaagggacccaattcagcccaactgaagcacgtttcaaacttcagtggcactgctgggaatagcattaagaatgaggtaaaactgaacagtgggaaaccatccaggggacagcctgagaatgaaatcaatgaattaccaaatggagagagttggagtgactgggctcttctgaaattgtttagagtcctgaattcagttgtgattgaatccctgaagttttcatatatttatgtaagcctgtttaagctgggtttccaccacttactgaaataatcctgattgatacaatgatttagaactgccttcaatatctgaaactgctctttcagaattcaaagtgaaagattttaagtgtctacactgactggaggtacagaattagaatgttgtgatatttgcattctaccacctgtcagctagtgtttaatcacttaattcatctgtttgttcatttttcatctgaaattttattaattttctactatgtataaggctcaattaacagcacaatattaggccctaagtatataattatcagtaagacagagtccctgttcccaatgaattcataatttattatggcagatggtccattaaaataaaaattattacattaagagttgtaacagaagtagaggtatatgcaaagtataaataagaatttagaaaaaggagcaaaatcctttctgggaggattagcatatttttaatatgtgaaaataattttgtattgagttatgataggctaataaaaacttgtagataaaaataagcatacaataaaaaattataaacaacttctgttctggggctcaaaaggctctaagaacatacaatattaagataagggtgtgcatgaaagaaacaggctcagctccatagccagagtgtaacctgcagacggctgaccggttaaagggaatgaggtccccctaactctctcattgaagctatttactcgagatggaaccacttatccagaaccagaaataatcctttcggtgaagcaggcaaatctaggctactttttctctcttctttcaaaaccaaaattataatcttaaaggaaaaataaaagttgggttaagagaaaaaaaatctagttatatgccatttataagaaacacacctaaaatataaaatatgcaaggcatttaccagcccaaaagagctgatgtaattacattattattagatctagcagacttgaaggtaaactacattgtttaagtgtgtaactaaatagtgattaaaggttatattcatcaagaagatataaaaaccatcattttttgtgtatctaataacatgaattccaagtataaaaagtgaaaattgatgaatatgtaaatagagttgggcaaatccactattagagagggaaattttaagacatttttctccagaagtcaagcagatagagaccacaagaacagagaaaacttaaacactaatattaacaaacttgatctagtggtcatctatagaatactgaatcctcaaatgggaatttacatagtttacaggcgcacctggagtatttgtgcaaaccaaccacaagaaaggccatatgtgtttatcagcagtagtatcaattaaaaaattatagcacatctatatagtgggttatactataaaatgtaaattaagaatgaacctataattacatgtatcaacctggattaagatgaaaagacaaaattgaatggaagaagaaagtcactgaagaatatgcatagtagaattccatttacatgaatttacaaaacacgcaaagtaccagatattgtaggagtatatttatagatggtaaaagcatggcaaaaacaaaagaacatttacctctaaatgcagagagggaggaggtagacacaattagagagagacacacaaggggcttccaatgttctatttaatatccttaatagggtttgttttatcatcattgtttaagctgtgcacatatgtttcatatttatcatatgttaaacacaaactttaaaaaagttaaaatgtgcagaactggaagtagagtgcagatttgaaatccagttctgcactttactagagatgtaaactatttcttaatctatagaatcatgttaccatcagcatcataaggttgctgtaggaataaataaaatgatacatagaatataacaggaacttaataaatatcagtttcctttctccttttatatcagacattaattagtagacatttctcaaagggagacatacaagtggccaataaataaatgagaaaatgttcaacattgctagtcatcagggaaatgcaaatcaaaaccagaataagatatcatctcattagaatgatcattattaaaaagacagaaaataacaaatgctggtgagaacacagagaaagggtgatttattggtgggaatgtaaatcaatacagctaatatgaaaaaagtatggagtttcctcaaaaaaataaaaatagaactaccatatgatttagcaatcccactactgagtatatataccaaagaaagaaaatcagtatatcagagagataatctgcattctcaagtttattgcagtgttactcacaatagccaaaatacagaatcaacataagtatccaccaacagatgactggataaagaaaatgtagtatattatacacaatggaatattattccaccataagaagaatgaaatcctatatttgccacaacaaggctagaatgggaggatattatattaagtgaaataagccagacacagaaagacaaatgttgcatgttccaactcatatgtggaagctaaaaaaaaattgatctcatggagatagagaataaattgaatggtggttagcagaggttgggaatggtagtagggaaggggcttccacttggacagaacagtgtatggagactcacatcatggacttttgctccaagaaccactacagtaaagtaccaggaaaacttaaggatttcatagatcctctgacagaaatggcatgctgctacaaattctgcaagacagcaaaaaaactgtgagttcccaaagtgtgtgagggggaacacctgcctccagacacacatccccactggggaccctgaaaacccagattacaggagaaggatttaaccttacctagagctgaaactgatttagcgtgaaacataaaagtagaagcagcagcaggaagagcattgtaggcactcccattctccagctcaagccaagggaagccatccttgactatatctcactagggccctcagggaaggcagccggcagaatctgggaggggtcacaggctgaaaaaagattccaactgaactttgtaataattttgactgaatgcaaactctctagagcagaatctgagggtgaaacggaactgttgcagagagtagcacaggagccaaggccaacagtatttgaaggcagggaggggcgaggcctgaaagccttgcttgctttctcagcagggaagcttatagcctggggcaaggtctgaatgctgagcacaggctacctggagacaaactcagtgctgttagtagggcacattgtcaggggcaaaaccgacctctacatgggagctgggtaagacctaatgctaccggctttcccctacttctctgatgacagagggtattatggaacaaaatgccctctggaacataaccccattggcccaagaaccacaccccctcccccacaggagtgtggcaagccctgcccaaggagagagtctgagctcagactggcgtaaccctgctcccacctgatggtacttctctacccgcctagtagccaatcacaaaagacataaactcttgggagctttatggccttgcccatcacctgagaaacccaaatacttattctggccaacttagggcaagcttatatcccccttccactactgcagctggtgctctcttgaaagcaatacctcctggctggaggccaaccaactcaggatattatggcaactcatgacaaaataacctgacaaaataaccctactccaaggaagtactcaaaaataactcatgacaaaataaccctactccaaggaaggagaaaacaacagctaattccactgactgcaacaccctggctaaccagaggtcctgagtctgttcactgctagcataaccagcatttgagaaagccagcacgtgaaacgtatctacaaccaaggactcttacagtctacttcactcccctgccacctccaccagagcaagtgctggtatcgacagctgagagacctgaaaatggattacatcacaggacactttgcagacaatctccagcaccagcctggagcctggtagccctgctgggtggccagacccagaagagcaataacaatcactgcagtccagctctcaggaagccccattcctagaagaagggggagagcaccacatcaagggatcaccccatgggacaaattaatctgaacagcagcccttaagttccaaatctttccactgaaacagtctatccaaatgagaaggaaccagaaaagtaattctggtaatatgacaaaataaggttctattacaccccaaagaccacactggctccccagcagtggatccaaaccaagaaatctctgaattgccagataaagaattcagaatattgattattaagctactcaaggagataccagtgaaaggtgaaaaccaacttaaagaaatttaaaaaaacaaacaatacaggctatagatgaaaaattctccagagaaacagatatcataaaaatataatcacaacttctggatatgaaagacaaactcagagaaatacaaaatgcactggaaagtgtcaataatagactaggacaggtagaagaaagaacttcagagctcaaagacaaagcttcctaattaactcaatcagacaaagacaaagaaaaaagaacaagaacaacaaaaaaagaagaaagcctccacaaattttaggatggtgttaaatggccaaacctaagaataattggtgttcctgaggcagaagagaaatctaaaactttggaaaacttattttaggaaataatcgaagaaaacctccgtggccttgctagagatagagacatccaaatataagaagatcaaagaacagctgggaaattcatcacaaaaagatcaccacctaggcacacagtcatcaggttctccaaagtcaagatgaaggaaagaatcatacgagctgtgaggcaaaagcatcaggtagcctataaaggaaaacatatcagatttacagcagattcctcagcagaaaccctacaagccagaagggattggggtcctatttttagcttcctcaaacaaaataattaccaatcaagaattctgtatccagcaaaattaagcttcataaacaaaggagaggtaaagtcgttttcagacaaacgtgtgaagagcattcaccactaccaagtcagcactacaagaactgctaaaatgagttctaaagcttgaaacaagccttaaaatacaccaaaatagaacctccttaaagcataaatctcacaggcctataaaacaacaacacacacacacaaaacccacaagatattcaggcaacaactaacacgatgaataaaatggtacctcacatctcaatattaacgttgaatgtaaatagcctaaatgctccacttatggcagaatgaaaaaaaaatccatcaattaagtatctgctgtcttcaagaggctcacctaacacataaggactcaaataaacctaaggtaaaagggtggaaaaaggtatttcatgcaaatggaaaccaaaagcaagcaggacctcaataacagttaaaaaaaagacaaagagggatattatataatgataaaaggatcagtccaacatgaaaatgtcacaatcctcaatatatatgcacctaacactggagcttccaaattgataaaacaattattactagacctaagaaatgagacagatggtgacacgataatagtgggggatgttgatactctactgacagcactaggcaggtcgtcaagacagaaagtcaacaaagaaagtgaacttcatctatgccctagaacaaatgaacttaaaagatgtttacagaacattctacccaacaactgcagaatagacattcttttcatcagagtatagaacattctccaagatagatcacatgagagactgcaaaacaagtctcaataaatttaagaaaatagaaattatatcaagtaccctctcagaccacagtggaataaaactggaaattaactccaaaaggaaccctcaaaaccatacaaacacatgaaaattaaatcatctgctcctgaatgatctctgggtcaacaatgaaatcaagatggaaattaaaaaattatttgaactgaacgataatagtgacacaacctatgaaaaccactgggatacggcaaaagcagtagcaagaggaaagttcatagtattaaatgcctatatcaaaaagtctgaaagagcacaaatagacaatttaaggtcacacctcaaggaagtagagaaacaagaacaaataaaacccaaacccagcagaatataaaataaataataaagatcagagcagaactaaattaaattgaaacaaaaaatacaaagataaatgaaacaaaaagctggttctttgaaggataaataaaattgataggcaattactgagattaacaaagaaaagtagagagaagatccaaataagttcaatagaaacgaaatgggagatattacaactgatactacagaaatacaaaagatcattcagcctactatgaacacctttacgcacacaaactagaaaacttagaggagatgtataaatttctggaagtatacaaccctcctagattaaaccaggaagaaacagaaactctgaacagattaataacaaacagaaagatagaaatgatcatttaaaaactgccaaaaaaaaaaaaagtccaggaccagagagattcacagctgaattctatcagacattcaaagaagaattggtaccaatcctattgacactattccaaaagacagagaaagaggggatcctccctaaatcattccataaagccagtatcaccttaataccaaaaccaggaaaggacataacaaaaaagagaaactacagaacaatatccctgatgaatatagatgcaaaaatcctcaacaaaatactagctaaccaaatctaacagcttatcaaaaagataatacacaatgatcaagtgggtttcataccagaaatgcagggatggtttaacatatgcaagtcaataaatgtgatacatcacataaacatcattaaaaacaaaaatcatatgatcatttcaatagttgcagaaaaagcatttgagaaaattcagcatcattttatgattaaaaccctcagcaaaactggcatagaagaaacatacctcaaggtaataaaagccatctatgacaaacccacagtgaacattatggtgaatggggaaaagttaaaagcattcctgctgagaattggaacaagacaaggatgccgactttcaccactgctattcaacattgtactggtagtcctagccagagcaatcagacaagagaaagaaataaagaatcggtaaagaggaagtcaaaccattgctgtttgctgatgatatgattgtatacctataaaaccctaaagtctcatccgaaaaactcctagctctgataaatagattcagtaaagtttcaggatacaaaatcaatggagacaaatcattagcactgctatacaccaacaacgagcaagctgagaataaaaatcaagaactcaaccccttttacaatagctacaaaaataaaaaataaaatacttagaagtatacctaaccaaggcgggtgcggtggctcatgcctgtaatcccagcactttgggaggccaaggcaggcggatcacaagaccaggagatcgagaccatcctggctaacaaggtgaaaccccgtctctactaaaaatacaaaaaaattagccaggcatggtggtgggcacctgtagtcccagctacttgagaggctaaggcaggagaatggcatgaacccagaaggcggagcttgcagtgagccaagatcacgccactgcactccagcctgggtgacagagtgagattccgagactccgtctcaaaaaaaaaagaaatatacctaaccaagaaggtaaaagacctctacaagaaaaactacaaaacactgctgaaagaaatcatagatgacataagcaaatggaaacatatcccatgctcatgaatgggcagaataaatattgtgaaaatgaccatactgccaaaagcaatctacaaattcaatgcaattctcatcaaaataccatcatcattcttcatggaactagaaaacacaatactaaaattcctttggaaccaaaaaagaccctgaatagccaaagcaacactaagcaaaaagaacaaatctggagcatcgcattacctgactccaaactaggctatagttaccaaaacagcatggtactggtataaaattaggcatgtagaccaatgggccagacaagagaacccagaaataaagccaaatatttacagctaactaatcttcaacaaagcaaacaaaaacataaagtggggaaagaaaggacaccctattcaacaaatgatgctgggataactgcaagccacatgtgaaagaataaagctggatcctcatttctcatcttacacaaaaaatcaccttaagatggatcaaagacttgaacctaagacctgaaaccataatattctagaagataacactggaaaaaaatcttctagacacaggcttaggcaaggaagtcatgaccaagaacccaaaagcaaatgcaacaaaaagaaaaataaatagatgggacttaattaaactaaaaagcttctgcacagttagagaaaaaaacaacagagtgaaaagtcaacctacgtaatggaaagcaatattttcaaatcatgtatctgatatggggttaatattcaaaatctgtaaaacactcctataactcaatagcaaacaccaaattactgggctaaaaattggagaaaggactttggagtattcatcaaagcaactgaaaacaggatctcgcaggagtgcaagtatcctgtttacatcaatgttaacaggataaaaactggatatttatatcttgttgatataaacaggatatttgcactgctaggttcattgcagctttattcacaatagccaagaggtgtcaacaacccaaatgttcattgacagatgaatgagtaaagaaaatgtggtatatacaaacaatggaatattattcagccataaaaagaaggaaatcctgtcatgttaccagatggatgaaccttgatgacattatgtgaaataagtcaaataagccagtcataaaagaacaaatgcataattccatctataggcggtatgtaaagtagctaaactcatagaagcaaaaaataggatgctaattgccaggggctgtggggaggagggcaatgagaagctgctgttcaataaatatagaatttcagtcatgtaaaatgagaaatgtctacagatctgttgtacaacagtgtgcacacattttgttacaatactgtaaacaaatcagtaaaacaaatttactaagggggtgtatttcatgttatatgcttgttcttatttaaaccctttaattttctatttaagatctgtcacaatctgctttctacctttttttttttaagtcaggtaggtttacttctgctctccattccagtgttcattttgtatctctcatccctcggctccacttggcctgatccaaccaatctgactaaaatcccaacttctctattttctcagaaaaatgatcatacagattatcctctcctctgaactccctcctactcacttatcatatgttgcccagttattgtgctttttaccttttcacttatgaagggctcatgtttccagagaattacaagttcctaacaaaaagaagaccatgttttaattttgtttttgagtcactgcttaaacacagtacccttcccattgtacaaactcaataaatatttcttagctgactaaatgttacctggagaataaatgtcttatacaagaaatctgtgtataaaatcctgttatagtatatagaatgtaaatcttcaggactgggtcaaagtaatcttagaaaactgtgtagagttatacatcttcctcttaccaagttagcttacctctctacagataaatacatgacatactgtaataattcagtgcaagaactatttccatatattacacaacataatcccacaaatagtaagctttctataaaaacttatcaggtctgctatgcaaaagacaataacagcctcttttagcatccctaattccatagccaaagtaaaaacacaaacctttatagcaacaaataaattattcctctgtttactggagaatagagaatatttatttgctactcttaccttctgcagtaagcagcaaaagatctggttttgctaatgttacgggattcttgaaagcggattcccaaactgtgtagttctcaaaaaggcttactgatgtatgttttgtatcttaatacaaatatacacacacatacaaatccacaatcagtagaactataattaacacaagtttccattcctactttgaggtttttagtgaactggcagaaaatgaacagaaaataaaagccttctttattgctgtgccaaattgctctggaaagaacccaaattgtttgcaaatagggtaaccatgtatttcaaatacagtgcacatgattttctcgatgaccacattgtatagcctcaacagagctttagcagtttttatcattcccatttgccaaacaagacatgtatataaaaatgaaagaagtttcaagatgcttgcttctatgatacagtacacccagctaaagaaacacatcatgttaacagggtcagtatgtttggctgtttttcccctctgtttctagaaacaatttcaacaaaaatgagaaggaccaagaagatagacaaaaccagatccttctcaatctacagaacagaaaattattattttcttgttcttttgataaaatcatcccaggatattcttttaaaattcagtgatgtgtataacatcaattagtctcatgatgttggtactaatgactctacatactcatgtttattaaataaacttagataatggttgaatttccagtgggtagtaagtactaacattgttgttcattaaaatgtctagctttcaagtcttttgccccagttttgacattctaatttcaagactaaaagaattagtgagaagaaagttctaaagatcactgtcataaaagaaaattaaataggtcagttggctttcttcagttctctgacacttaaacttcaagagaaacaaaattcccaaactgaagagaactttgaaagttctctggttcttcacctagtatgatatgcacacttaaaaacattaagttctattattacttccacctgaagtacatatttctcaattacccaggagagaatctattgctcaattatctaggctctcagagcacttcaccaactcttttatatagaacttcttatatttcttaattatgattattttttatctctcccactaaattgtaaccttatctggaggagggatgagagtttagaaatctttataatcccacatttattacttggtctaacacagaagaagctcaacaaaggttgaataaataagttattgaatgaatggataaataaatgtatttatataatgtataaagttcaagttcctatgtatgcaccaggtgaagggctaaagttggcaggaaaaatccgcaactccattctctacactatttgtctctctcaacttccttcatacttctatttctgcttttcaacctggtttaccgcgaactattaattatttctacctctagatgtcaaacggtacctcaaactaaatataaccagaatcaaatttcttatcatccccatcctccaaaactgctcctcttcctgagttgcctatttaagttcaatgacatcagcaacccaagtcaaaggctgctttatctttgacttctctttcttccatcaccttctgttaatcagttaccaagttgttttgtttttatttccaaaacactttttaaatggtcattcaattaatcatccattcaaccactattcactgagttatttatatgtgctatccatattatagttattatgatgtatataaaatcaattaatctttctcaaaaagattacagtctaatagacacataagcacatcagaagttataatacataaagataagtgcttgataggttttttttcaggaatataggaaaagaatattccaattagatttgggaggaacagaaaaagcttcctggacatgttgcatgtgatgtgtaggtattagctagatgcagaagggcataggaacatatatatccagacaaaaaatatggcatgtaagaagctgtgagatttgagtaagtatggcatggtttggcactctaaatagtttggctgaagtgatgcttttggaagagtgatggtggatatgactgtataactacagaattatacagagagggtttggtcataaagaacgttgtataaaaagttaaaaagtacaagccttaacatggaagttgtggaggtcactgaaggatttaagcaaaagagtgacatgatgagatctatactttaaaagattattccatctgcagctggaaggtagataggaagaaatgccagattggaggcaggaagaacaactactgaaggacaattacactatcctggtgaaaaataaagggtgcctaactacaagattggcactgagaatgattttaagggtaaaggggaaatttctatcaaaggagagattgggataaaggtgataattgatggcatgaggtcattgaagagtcaggggaggatttgatgcaaaacatatgcagaacttgaagaggtgaatgaatgcttctgtggagacagaaaggaagtgggaaagatccctgcatataggtataagtttgtaggtggcaggtggggttgcctgataaactacaggatgctcaattaaatgtgaaattcagataaacaacaaataacttctattataaatattttccaaatattgcacctccaccttttcacaagtttctttttcctgaataccatacatccccttgtctgcttcacaaattcctactcattcatgtaggttcaagtgctatcttccctgcaaaacataatttgacttccctgaccctgtgctctcacagtattgctgattatatattattcattatgattattattaaggttttcctgaatatctttctctagattttaagtttcttgaaaacagggatcaggactcttttttttcttgaaagtagggatctctgtagccttatggtctagcacaatggctgccatgagaggcagccaatatctgctgaatgaatgtcctgtttccaatctttattatttattgcctagttttcctgtcttcaatttctcccctctttaaaccatcctccaaactgacataagaggtatctttttaaaatataaccattgaagatactttactactcaaatatctttgattacttcaagatgcccgtctgatgaagcagaaactcttcagcatggtattgaatgctctacgtaatttactatcaaagctaagggtattagagctcagactttgaaatcatatctgtgttagaattctggctatatagcttaaagttatgtgacttcaagtgaataacttaatcatctgtaaaatgggaataactacctcataatgctgttgtgaaaattaaatgagataatgactataaacgagataatgtctatgaagcatttactagagtactgtgctgctcaatattaagaacactaacaaatatagctataatcaagatcctttccagcttcatctcctatcatttcatctctctctactcccattgatacctccatagcagctacatttcataacttgccaattctcccaacttcaggctatttcatccttacatgtgaattcataatgctttatttgcttacagtgcccattctacatcagcttgcatggcaaatcttggtaattaaaattttgctagggatatttcctagtatacatacaaaccagtaagtttgtatatataccatagtgttaaataaaatctgtgctgggaaaaggcctagaacgttgctttaaaatggttagattaaaagcattgccgaaataataaattagtatgtgagtcatcatgatgagtttcaataacggtaataagctaataattgtggtttcacttgtaagttaaaaatgcttgggtttcttcaggtcttttgtgctatgtagaggttcatggacaccacaggctttcttttatttcaatcaatggatatcttatgtccccaaaagatttttttagtggtcagggaattctcatccatttacttattttcagccttttatacgctatgactttttagagttttttctcctcatctcttccaaaaaaatccttctgggtgattttgcaaatattgtcacccttaatctcagttcatatcaaactagaaaaatcatttgcaactatctgaaacctaaagtttattaaatgtacctgagacagcttaaaaatatccagaaatgttctgatattcctaaaatatttttcccatttattgagaatcaggagctctagataaccataattgtttagtctctctcttcttcttcttcttacctttggtccttcagggccgttttgtccaggaatcccaatatctcctggaaaaccctagggaatataaaaatgtagcgtttattccatagaaaattactttaaatccatttagcatataaaattccctttgctattcctccatatccagttaaagcaatttataatcctcaaaaattcaatattgaagattaagttaggcagttgtttaacactggaatataaaacttacaaagtgtactaaaatagaatttactccatcagtgattcacaaacaatcctgaggtcctctagttcagtttaagagagtagaagtctcagtccaaaattatccacaatgtggaaataaggcaaaaaggtgtatgacatgttctttcaacatcatatgggatatagggctaccaaagattaggtgaatgtactttgttggactcactatttactaactacatgttaacttatagatttttgttaggcagagatgcaaacaacttctgtctgataaaaaaaaaaaacagcacccaaaattatggcttaatatacaggattaatcagttttgtatctaacccaactatcttattctaacatccccatatttaattgtctataaatacttaagtcctcaaaggctctatgaaccattatcttacaagttccatcattaattaataaattgaataaaatctttgacctgtgtttactttaaatttgcatgagaatcatgattttacttttttggaaattatattagcagtctaaaatacttggctcaagaaatgaaaaagaaatagaaatggatcacagtgttaaatacaatctatgctgggaaaaggcctagaatgttgctttaaaagtatcagattaaaactcttgctgaaataattagagtgtgattcatcaaattatgattcaataattgtaataagctagtaattgtggtttcattttattgattttgtcatagattattttccattgacattagtgaaggaaaaaagtaaaagaagtataagaatcagcatctttaaaagtaaagaaggctgaaattaaaacgtgaacatccacaagaaaaggtagttcagtgaagggataagttgtaatgggaataaaaaatatgaagtaagatggaacagcaaagttgtttctgggatattcattctggaaagaaaaacaaataataagaaaatgataccaacgtatccagtctggattaggacacgaatgcctcgactcagatttaaagcttggattctgtgaggaaaaatataatttggggacatttctggcaaaagaaaaagcagtggcaacagaaagatgatcacaagatcagatttctgaatgttctggaatagtttaatacagatatgtttaatacaaacttgttgattgctttactaatcaaagaaaatcaggctcacctatgctattatttgtatatatggcaatttttaaaaaactagattcttttcctgataattttacaccctttctctagaacacaccttttgttagtatgtttttttgtgggggggatttcttgtggacttgaatcaagacacttctagctcctgctgtaacactagctagtctaaaattgaacttactaccttctccattatgttcctccctcatcctctgttcactatttgagtgaatgtcaccttgaggtaatccaccagtttccaagccaaaaatctgtataacagatttttcatatgctttgaatactttcatatttttgatatactctgaatacttatttttccctccccaccaccaccacgaccatcttccaatcatttactaagccccatccattacatctcctaattcactgtcagtctgaaccacttttctacaaacctccctccacaaccctagggcaagtcactttctctattttcctattgcttattcatgttcctatcccctgtaaaattcattttcactccgtagccagactgatcattctatggaatctgagcatgccactttgttactggcctcagaatagaatccaaattctttaatacacagtttacagggtctttcgtgatttggtggtctctatttatctctcttctttactctctaccacccagcacttcagtcactgaacaattttcatactctgataatatatactctctttcaattctgggcttttgcatatactgtttccctcaccttgaataatgttcccttaagtttcctcacctagaacacttatgttttaactagacgactgaataacattttacttgcaaacttttctttgacctccataccttgaattaggttgcttctaagaactctcacaccatcctggggtcctataaggtcccttaatgtagtgttttggcttgttttgttttcctaatcagattgtaaactctttgagtgcagttttatgttattcacttccatattctctgcaactagtacaatgcctgatacacagtaagtgcttaaaaaatgctttgtcgttgttgtagttgctgctgttgaatgactggtttgttttttcttttcttttcttttttttttgaaagaaagtacatgtttcgtggcttgttgtagcccctcagtactggctttcagccaatttagagcatttactcatagcatctgcatggataaatcaataaatcctgtccatcctccagataagcctggaacacactatcacagcagtctccaacctttttggcaccagtttcatggaagacaatttttccataagattgcggcatggaggatagtttcgggatgaaactgttctgcttcagatcatcaggcattagactctcataaggagcatgcaacctagatccctcacacgtgcagttcacaacagggttcgtgctcctatgagactctaatgctgccgctgatctgacaggaggtgaagctcaggcagtaatgcttgctcacctgccactcacttcctgctgtgcagcccagttcctaacaggtcacaaaccagtacaggtccacagcccaggtgttaggggcccctgcagtatcatgccagaaaacaagaaagctttcgaaggtatcaaaagtagagtcatattaaaaacgcttagtaggtgcttgaagaggatcccctcggccagatatgggacaatatgaacttcaacaaggataagaactacaatggattgaaacacatcaaatatgtttaagttcataagttcataatgatacaacaacaaaaactgtccacgttcaaaggatgaaaggaggctcactcattatcttgaaacatggtaaacaaaggtgaagaatcaagaatttgttctgccttagtgtaccactagtaaccaaacagtagatgaagggatgtattccagccagtaagtgaaaaagaaagaagaggattaaaaaaatctccattttgcaatgatacaaataatctaattgatctaggcactgagcatcaactattactaacatcacacacacaaaaagagatcaccagacattatgtgcttcctgataaaagaacagaataccactgattgtcttgccaaaaacaaacctgaatatggtaaggtctctatatgtgactaccaatttgcaggaaacacacaggaccaagaaacaggcagaactacaccatgagactataatcagcaaaatccagactgtgggaaactacagatcaaatgattggggagcttcaacaactaaattttaagggggaaaacagggaatagagagagaacttgtagagtgaaagacataggaaataaaacaaataagcctaaattatagtttttaaagatgcacacttgtgtgataaactatgttttaaaaaggaggaactgcttacttttgggaggagagctgggcttgtggtttcatggggcacataatggcttctggtggtaactgtcagttttagtcttgacctgtgtggtagttacaagagtctgtcttataattgtttgtgatatacatttgttttgtatagttttatgtgtctatgttttactttacaataaaacggtaagaaaaaatttgctggggtgacttctgggtaaacatgcaacactgaatatacgtgtgaatctctgctccttaaaacgtcattaaagtatcagtggagaaatattaaaaagacaaagtggtaaggtcaaggataatagaagaaaaagatgtcaacacagctgatctcatagtatagtcatacaagctgaatattttaaaattgaaactttattgaaaagctaacaaatatataagcacaagtttattttttattttttatttttattggcttgtatttatttatttattttattattttattattttttattatactttaagttttagagtacatgtgcacaatgtgcaggtttgttacatatgttacatatgtaacaacatgtgccatgttggtgtgctgcacccattaactcttcatttaacactaggtatatctcctaatgctatccctctccactccccccaccccacaacaggccccagtgtgtgatgttccccttcctgtgtccatgtgttctcattgttcaattcccacctatgagtgagaacatgcggtgtttggtttttcgtccttgcgatagtttgctgagaatgatggtttccagcttcatccatgtccctacaaaggacatgaactcatcattttttatggctgcatagtattccatggtgtatatgataagcacaagttattaaaaggaggagaaagatctctatttccttcccacataggagagcttagaaccctggccaaagaaacttttcattattttaaaaattcatacctagattactaccaagtagagaccttgccttttaaataatacatttcaatatgttaaaaccagagttaactgtatcaactgaacattaatgataacgtacctataaaggaaaccttttttttaaacacactcaaaatgtacatcaaataacatggacatctttgccaagtagcaaaatttcagaaagcttacagattgaaaaataaaaagtacgtcattagagtccatacttttcatttctaaaaactacattagcatgaaacgatacaggaagaaaagtaaaaacaaaaatctgataaagatgctctaattcatttttataaatttaaaataatttagaaaacattaataagtccaaacattttctctcacaatgtgttttaccacctcagttaagtcatcctatcagaatttaaaatataataccttagtgaaggaaagaaacagcagtctggcttctggtgtcttcttaatagaactagtctgaccaccaatttttaccaagaagcagaaaaaagaagtagttttaaaaatagtatgtgaaaatatgtcttctgttttcagacccttcacatctgtttgccgtactgagaagagtgactcagcattctctccagtaaaaacaaagttttattattctataatcactagaggctggagactaattcacatgcattttttttttaaagcaaaacctgggaaccgaagcactagcagattccattagtttcctgggaaatcataaaagtaaaatattatcattcttatttggcagtagccagaagcttggaagctagagtgtcctaacagaatacattatattatgcgctacatacattgagcactttaatagttttccaatagaagtgttagagtatctgttttctattgaaatatatagtccctcaagttaaaaaatggtaagtggataaacttatacacatatacacaaactaattacaatatatccataaaacgaacagcctagatgtggcaacctagacgaatctcaaatgtcttatgctaagtgaaagaagccagacaaaaaaaaaagagtacatactatgtgagtcagtttatataaagactttagaaaattccaattaatctcgagtgacaaagagcagatcagaagtagcatggaaagggagaagacaagaggaacagaaataaagtattatataaaaagtgaacaagtaaattactgggtttgacagatatgttcattatcttgatcttggtgatggtttcacaggttatacatatgtcaaaaattatcaaattgtaaaatttaaatataggcagcttattatatgtcaattatacctcaatgagcctgtaaaaagaaaggtatttagtattgggtattttagataaccatatgctttatggtaggcaacattttttaaggatttaaagatctttagagagaatatataatatattagttgaactagttttcagataaaatcagtgttgctcagattttggcttgttttagaggtaatagcatgttaaattataataacagctttaaaacaaattacatattttggaaaattgaaacttttctgatattttgcaaggtagctttaagatgtcctgttgttatagataagagtgacacttgggccatttaactcccatggaaaatttcaattattgatttaatatccactgtgctttaaatatacaagaacacagcatagtttggcttaaatgtatcttctgagtagtttataagtctgaacaaagtagagatgaatatagcccttggaaaaacaatcattaaaaaaagctaaaagataaaattaataaaggcaacatgtaaattatgaattcttgagggcaaagttatgcaaagccttggctggtgttgtgtatatatagtattattgaatatatagtttatattcaataaacattcaatggcctgaattgatgaccaaattaaaaataaatcctatttgaataataactttttcaattaggcagtttcaaagttatcctgaaaaaaaaaaaaaaactagcctagcttctacagacaggactgaaattttacatattcaaacgagtaagaatgtatgcagagggagagaggttttgtaagaggataatttggtctgagacaaggatgcaggttacactcacaagattttgttttctaacatttatggaagcacatgtcatgtcagtaatatgatgagtccaggtaggaaagtaataataaaaaagaaaaacattaaaatagcctttactgagtgagaataacctatccaaaagttaatgccaaaaaaatttcaaaaggcaaatgtaataaattcactttcccagtaatctatagaaactaaactttagcacagggaagcatgcaaactgcaaatgaaggaaatattctgtcttctgaggaaaccacaaacagaaaatacagtttcttgaaaatgcaaaataatccatctaggtatctgcctctccttcattttcttttgctgttttagatctaaaagccatcaaaaccaggtattttccatcatgatactgctgagaaatttagtgactactgctattcatatattttcccttctgtaattctatgtatttgagcagaaaatatagcacagctcaattccatatgtgcagcatcctgaaaactcaacagagaaaatccacaaaactacaaagacaataaaattccttatgacaaaacatatattctgtgttccaaataagacttttgtttagatagtatttacagtattttttttaaaaaagattgattcttgctctgtcaatcaagctggagtacagtggcatgatcacaggtgtgtgccaccacgttcagctaattaaaaaaatttttttttttttagagatgtggtctcgttttgttgcccaggctggtcttgaacttctggcctcaagtgatactcttgcttcagactcccaagtagctaagattagagatacaagcgatctgtgcccagatattcacagtgtttttaacatcacttttaagggaaactacaaagttagctggaaagtctacttttagtcttctaaagtccacataaaattatagttaagttataattcaaaaataaactattctggccattatttgatatttaggtttggataatccatagtgacaaaaagcagatccccccatggtaccctgaggagggaggggggaaggagaggcagaaaagaaggattacaaatgtaaacaagaaaatttgggggtttgatgggtgtgttcactatcctgattttgttcattgatatggtttgggtctgtgtccctatgttggaggtggggcctggtgggaggtgactgaatcatgggggcagatttcaccctcagtgctgctctcatgatactgagtgcttgcaagatttggttgtttagaagtgtgtggcacctctcccttctctcttcctcctgctccggccacgtaagatgtttctgcttaccctttgccttctaccatggttgttaagtttcctggggcctccccaaccatgcttcctgtacagcctgcataactgtgagccaattaaacctcttttctttataaattactcagtctcaggtatttctttatagcagtgcgagaatggatgaatacagtgatggtttcacaatttatacatatgtcaaaagttatcaaattttaccacatataactttgttatatgttaactatacctctataaagctgcaacaaaaaaaggtaattggtattaggtgtttcagatgctcctttttggtaggcaacagttggtaataattcgaagatcttttgagagaaaatagaaattatttattgaacttgtccccagataaaatcagtggagctcagattttgaattgtttgaaggtaacagcataaccattatttactgcatatttttggctaagtataattataggtactcaatatctatatatctgtctcagaattcttataaatatcttaagaatatcaattcggctgagcacggtggctcacacctgtaatcctagcactttgggaggccgaggcgggtggatcacctgaggtcaggagtttgagaccagcctgaccaacatggcatggtggtgggttcctgaaatcccagctactagggaggctgaggcaggagaattgctagaaccctgggggcggaggttgcagtgagctgagatggcgccactgcactccagcctgggcgacagagggagactccatctcaaaaaacaaaacaaaacaaaacaaaaaacaaagaagaatataaattaacttagtcaagacaagacgtagttactatgtatcaggcactgttcttgcactgatcacatactagaaaacaaacaaaaagattccttggtttcatagaatgtatattctggagactgtttatctcagagattctctccctttcaatgtgtgtatgtttgcagcatggagtgggaagttaggtgattaaaaaagatttatattgttatgaggaactggcatgtctcaattacctacttttgttttagatacacagctatgggtctatggtcactctatgttgtttcacattctctctttcttcaaatgggatatcttgttttctttcatatatatatgtgtgtgtgtatatatatatatatgtgtgtgtgtgtgtatatatatatatatatatatatataccagttagtagaaatgtatacaggtacttaggcctcattgaaaataatgcatcttaccctgagaacttggccttagacatgtaagcaataattggccagtaccttggggtactttcctttggagaaaggagagtgcattttcagctgtgtaggtgcctgcactatgttaggcaaaggcacgtttaaaactgtataagtagcaagagggtataagtagatattgggcaataaagatgtgaaatgtagaggacatgtcttcaatctgctaaaaatctctttggggaaacattattccccatttctcagtccatgtactctcgtccccatcccagtttccaggggtgggaaaatgacctaaatcttgcaaattacagtattcctattccattgctattgcaattgattgaaagatgatcatgtgggccgggcgcagtgactcacacctgtaatcccagcactttgggaggccaacttgggtggatcacaaggtcaggagttcgagaccatcctggccaacatggtgaaacctcatctctactaaaaatacaaaaattagctgggtgcggtgacatgcgcctgtagtcccaactactcagaggctgaggcaggagaatcgcttgaacccagaggcggaggttgcagtgagccaagatcgcgccactgcactccagcctggctacagaaaaaaaaaaaaaaagatgattatgtggtcaaagcctgattggctggagtctcctaagaacttttgctagagatataaggaaaaaaagagtgctttctttttgcttagattgctaaatctgagggcaacagaagcctagagttgccaatgaccactttttctacagtgtgttcctgtgaatgtagccaacagagaaatgccaggataagatttacagagtgtcttggttatattcatcaagttcctgtacctagccaagtctctagacacatacactcctggacttcctgattttatttgccaattctgatttttttaacttaaaactgttcaaactgagtttctgtcacttgcaatggaaaaagacctgactaaaacattgaactatttgcagttttctacatacatctagcttcttcacacatctgtgcttttacaaatgctgtttcctctggctggaatgcccttgccctctgtttctacttgataaatccctactatttcttcaagtcactgctcaaacacccatgtactccatgcccctggttcttgcaccacgtaacttgttacccactcaaatgtaatatgatctatgaaaactttcacaatccaccttagtcagaatcagcactgattattttatatccatacacaactctgttaatatggctagttagcattattcatactatactgtaattaagggcatgtttctctattccaataaaatgtaagctcatgcaggaaaaggaatgtatctgacccatttttgtacctccaatatttaacttcacatgtcactgggagataattcttcattggtcccttgcatttccacacattctgcaaatgaggtattgactttgcattattccagtcactctcttcagagatttttgcattgcttcctgaagcaaagggcaggaaggaatgcgtactgtccaagataacgagataatatctctctggaatacattatcttttctgactgcccattataaaagatttaggctccttaaacttcagattcctcttatgtaatgcaacctaccgcatatgcaagtatcatctagccctcttcttgtcaccctgtgggaagtggggctcagtgaatcagtgcaaaaaagttgacactctggaaagtgcttttgccaagagtaataaactatcttttgtcattgttctaggagcttgtgtcttttaccagaatcattgaaactgtcaggctaaattgttggcttgcaaatggaataaaatctccgattctgacaattttggtgatgaagatgggatactgatagagacatagctttctggaggaggaagtattagggcctcacagatgattaacaggatttgagagaagcccatgggaaatggcaatgaatatgtaaaccaaatatatggtcaaccaggcaataaatggtcctccactttattgcctgtttagaggaggtactgggagagacagcttcaggccaagtacagggaaataagttcaaagggcagaaagacttcctcatcaatctggtgaacagtttcaggtttgcaacattgtaacaactagtactaagattccagctgggggcagtggctcacacctgtagtcccagcactttgggaggctgaggtgggcagataggcagatagcttgactagcctgggtaacacaatgaaaacccatctctacaaaaataaaaaataaaaaacttagctgagtgtggtagtgcatgcctgtggtccaagctatttgagacgttgaggtgggaggactgcttgagcctggaggctgcagctgcagtggccgtgatcacgccactctagcctgggtgggcaacagaacaagaccctgtctcactaaaataaaataaagtaaaataaaataaaataaaataaaaaagaaaagaaaagaaaaaaaagattcatcctgggtaggcagaagactctatctccttgtagataatagttacagagactcccatctacaatgagtataaaaggatgaacatttgtgaccagtatgagcaaaaaccaggcaaagaaatagaactttggttggttcacctgggagatgagaggggggtctcatagtttttcacaacacaagaattgcaacattagcccacattgcctaaccactgaatatgctgcctctgacatagcttgaaatataaggtcttatacaatttgatgccaacctacttttacagccttatttgtcactctgtgccaacacacaaaaaaactgtatcagctagccagtgtcacccactcctgtaaatccaccatgcattaacctaggtctctaggctctgcttatatggttcactgtgcttggaatgccctcctcttttcctgcaatttattaataaacaatctaattcaaggtccatcatttctgtaaacccttccatcttctctatgaacccttctctatcctttcattttatgttaatctatctctactaacactgaactataacaactccttaattctcacatgatgccttcaccattacctaacagtttacatatagatttcgttcttcccaactagactaaattttcctaaattattgataacattttattttttaatatatcttacagtgattactaggcacatatttgcacatagcagaaacctaatactttttttattgactgatttaatcacacgtgctctttcagcatgacttaagtgacaattaaaaacatgaaatttctcatccaaatccaagtcataaaagatatcaaagaagtaaattgtttaggcaaagggattccattacattctaatcaattaatacagctggccacagtctagcttattccagttaagtccactgaagtactaaaaatgaagtttaaaagcatgcttttacttgatatagccagatttttgaaactcacttcagtctttgtctctaatgaagaccaccctgacggaaaaagaggacccactgtttggccacttctggcactgctgtgattagtggtcttgattcatttttgtcataaacaattggctccatataccaagtacatcatccaaaattcaaatatttggcaatctctgtagcccagggggcttaatagctgaatcaacaaacattccaaccatcctgctaccatataagaaggtgctctgctgccagaactgagaggatacatgggattagtgctcaaaactgatatgactatgcttaaagaaatagaaatgattcctgtagagcattttccatatgtttttattaaaagcagacaaaaaccagtatggaaaaaataaatctatgtattaaggcaagtgatgttttatcttggaacacctctaatatttacaattccatgaaaagctaaatgcactgatcttttcacttcattgttacagcatatgcaagtatcatcactgtcacattgcctagaataagtaaaacattaagaagagaaaaaaatctttgaagtggtttgaagtcacatttgctcagctggtctttaatgatgaacagttctcttcaatgccaatggcaaatagcatttacaacaaaaacttcagagtactttgctttcaccaactcttatgaagatttgagtttcctaactagaagtcactagcaagaaatggtggccagtcctgtcctgcctttttagttgagtagatgaccatttgcatggtatggttaagttgagaggtatgaaagtttctagtcatccataagtttttccctgctcactaaatgacaccctaaattctttgattaatgacattttgcattagtttcaggtttctgttcattgctgaaatgtaaatatccttgaaagaggaatacattgcagttagctcataatcatttactgctgggactgaaatatatttatcaggtctttccatgaaaacaggctttgatgggaagggcaaattataggggaaaaaaaagagcacaccgattgtttgagatggaaaagaactcatgcccaagggaggaaatatatatacacacacacacaaaggagagactaagagcctcaggaaaaaaagttcttcaacaatttacaactttctctgaggactgcactgattctagactttcaagggatgacctgatttttaagttttaattttatcaaacctaatcaaacctgatgtctgggaaaaaagacagacagagacagtagaggctttgacacggaatgataattgaatattgacttcttgactataagctcctgaagtcaggacctaatcttattcacctctgcactttttttcttagtaattgacatatataatagatatccccaaagatctgttgaaaatgaataataagaattggattgtctaaagaggagcataaaaggcagagatattcccataggtggatctttgggttctgatgatcagccaatcacttacatctctatgactgtcagtcacattgtgtgtggggggatgtcatagattagtgccaccattaaaaacctaaaagatttaggggtggtggtccctattacagcatcgctgaattcaccaggcgcacccctgcggagatcgcatagattctggagggtgactgtagactaccacagccccagttacagctgctttgtcagatgtagtatcattgctagagaagattactaagtcttcccataaatggtatatagtcaccaattaagcaaatgtaactttttcctttaaaattaaaaaagataataaaaaactagtttgcattcatgtaggatggacaatagtcacttacagttttcctgtgttctcctgcctctgtcatatgatacaggttcagtctgaagagatctgaaccttcagtgaataccacagaacatcaccccaatccactacatacgtgatgtcatgctgattgaacaagatgagcaagagatggctagtacaatagagaatttggcaagacacatgcactcaagatggtaggatatacacccttcaaagattcataagctggccaattttctgaagatttaggatcccagtggttagggatatacttgaatagcccctctaaggcaagagcaaattgagagtcttacatactccaccacaaaaaaaggaaaggcacaccttttggggtctaaggagcaaaccattctatacctaggaatactactctagcccatataccaggtgacactgtaggctgctagctttgagcagcacccaaaacaggaaagggcaacatcataagtctaggacatggtacaatcagtcccgccacttgcatatttaatccagaagaccctttagtattggaggtattatggtgggagaagatgcagtatggagcctatggcagtttgcagtgagagaaacaaatgctgcctctggaattctggagtaaggccatgtcatctgaagcagaaaatactatgctttttgagaaacagtttttggtgttactggaacctggtaaaggaaggacacttgactatgggacattaagtaaccacacacttagaacttgccattatgtcctgggttctgtcaggctgccaagacataaattcagatgggcactagcagcaatccattatactggagaaatgttatatacagaattgaacccaagtgggaccgggggaacaagtaagctgcattaataggtagcccaaaccccaatgtcaccttcacactcactgcagttaccttctcctagcttataactacaggaatatgtgttagggtgagaaaatagctcccatatgactagctggaggaggagaaaaagcttcagcttgatttatggttgggtcagcttggtaggcagttctagctgaaaatggatagcaacagcaaaaaaggtacacttatgcatactctgaataacaacagagaagaaaaaagtcatcctaaggggtagatctgtgagcagtgtaccagctcatcatcttttgtgtggcaagagaagtgacctgaagtgaggatatatagattcctcggcagtaatcaatggcatggctatctggtcaggggcctgggaggaaaaaaaaatagaggaagagagatctgagacagagtcacatgactagacacatgggattaggcaaagagtataaagagttcgccctcacacattaatgcccaccaggaagcatataccatgaaggaggttataaaaaaccaagtagacaaaatgacttggccagttgacattagccagccttcatctttggtcactcccagattggcatgagtatcaaatgaatggagaagacatggtagtagagacagaagttatgtatgagcccaacagcatgtactatcacttaccaaggatgttccagcttctgctgcctctgaaagttccatttgtcagcaaaaaaagaccaacaaagtccacattatgtcaccattccacgaagaaggcaaccagctactcggtggcaaatttcttacattgggcaccttccaacctggaagtatcagcagttcatcatcacagagacagatatttatttgggtaagagtttgcctttcttgtctctaaagttctactagcactactatctagaggcttacagaatgcctgatccacagacatgaaacctcacagaacacagcatccaaaaatggagaccctctttacattgaaggaggggcaaggagtaggcccatgatgtaatccattagttttaatcctgcccaatctagaagcatccagcctcacataacattggaatttccttctaaagttataattgatgtgccagttaaaagaaaataatgtgaaaaaatggtgtactaccctttagaacacagtggatttgttaaatcactgacccatatggagttttgtcccaaataggatgaacatttgggtctaaagaccaaggggtggaagcaggtatggtcctatttaccatcactcccaatgacacactgtattctgtgcttccttcaccacaccctgaactctacagggctgaagatcttgttacccaaagtggggggtctctcttgacagaagacacaacaaaggtcttaataaactaaaaattatgactgctaccagagcactttggactttttgtcaccaggtctgaacaaataaaaagagaagtcaccacactggcatgactaattgaccctgataaacagaaggaagcaagactgcttcaatccaataaaggcaggaaggaatatatgtgaaactcaggtgatacactgggcaccttcttgtactcctgtcaaacatacatgctcttcagcaatgaaggtttaggttgtactaccagataagctaccaagatctgctgaggtgatagctgagggtgaggggaatgtaaaatggacagtgaaagagtgagaaaagtaccagttgtggctctgagaacaactggattgacagaggccacagttcatcctattaacacagtcagatcacgtaaaacaaaaataagttaagatacagcaaatctaaataacataatcaataaggaagggcaaatcactacataccaaactttgcacctgataataagaatataccatcttgtcaagaagacattgaacattcacaaaaggtgaacatatattaggtaaaaaagaaaaagatcagtaagctccataaagtaaaaaaaaaaaagtctctgatcaccatgcaatgaaaccagaaattattaacaaaatcaaaactgaaaaagctctcccacttgaaaatttaaaaattgcctatttaaataattattgggtgagaagggatatacaaattgaaatgacaaaataccaaaaagtaattttaataaacatactccatatggagtctactgaacacatttaaagtaatgatcagagaagaaataacagaccttaataattttatgaataaaaataaaagaataaaaagaaattagaaaaggaacaaagcaagaatatcccctcttatgactccttgtcaacattatactggaagtcctagataatgcaatatgacaagaaaaagaaaaaccatacagattgagaacaaaaatataaagctgcctttgtcacagatgacatgattggctatgcagaaaagcagaaaaaaatgaacaaaatcctcctggaatgaataagcagttatagcaaggttgtaggatacaaggttaatatacaaaagttaactgacttcttgtataccaagaacaaactaatgaaatttgaaattaaaaacacaatacagcaccaactgtattagttggttattagcaccaactaatacttagttatgaacctaagaaaataagtacaaaatttatatgaggaaaactataaaattatgatcaaagaaataaaaaagaagtaaattcttcccaatgtgatctatagattcaatgcaataccaaacaaaatcccataagttatttgtggatactgacaaacagattctaaactttatacagagaggcaaaagacccaaaacagccaacccaacttgaaagaggacagagttggaggactgatactactggacctcaagacttactataaagctacaatattcgagacagtgtggtaatgaagaaaaaaacagataagtagatgagcggaacagaatagagaacccagaaatagacccacataaatacagtcacctgatctttgacaaaggagcgaaggcagtacaatggagcaaagatagtcttttcaacaaacggtgctgaaataactggacatctacatgcaaaaaagaaatgaatttagacacagaccttacacctgtcacaaaaattaactcaaaatagatcacagacctaatgtaaaatgcaatattataaaatcctagcagataatacaggagaaaatctagatgaccttgggtatgttgtttttagaaacaacacaaaagacacaatccatactgaacttcattaaaatttaaaacttctgccctgcagaaaacaatgtcaagagaataagaagacaaaccacagacgggaagaaaatatttgcaaaaggcacatctgataaagaactgttaccccaaatatacaaagaactctgaaaactcaacaattaaaaaaaacattaaaaaaaggccaaagaccttaacaaacacctcaccaaggaagatatacagatggtaaataagcatatgaacagatgctccacattatatgtcattagggaactgcaaattaaaacaacaatgtgggctggttctggttgctcatgactttaatcccagcactttgggaggccaaggtgtgatgattgcttcagcccaggagtttgagaccagcctgggcaacatagtgagaccttgtctctacaaataataataataataatagctgggcacagtggcacatggctgtggtcctccctactcaggcggctgaggtgggaggatcacttgagcccaggaggttgaggcgacagtgagccatggtcactctactgaactccggcctgagtgacatagtgaaactgtctcaaaacaaacaaacaaacaaacaaacccaccaccaccaccaccaccaccaaaacccagtgtggtgccactgcacactcactaaaatggccaaaatccagaacactgacaccaaatgctggtgaggatgtggagcaaaaggaactcttattcattgccagttggaatgcaaaatggcacagccactttggaagacggagtttattacaaaactaaacatacttttactgtgtgatccagaagccacattccttaattctacccaaaggagttgaaaatttatgtccacacaaaaccctgcacatgactatttacagcagcttcataactgccaaaacctggaagcaactaagatgtcctttagtcggtgaatggataaactgtggtatatccagacaacagaatattattcagtgctaaaaagaaatgagctatgaagccatgaaaaaacatggaggaaccttaattgcatattaatatgtaaaagaagtcaatctaaaaaggctacatactgtacgattccaactgcctgacattctggaaaaggcaaaattatgaagacagtaaaaagatcagtgcccataggttgctgagggcagggaagaggagggatgaacgggcagagcacaaaggatttttagggcagtaaaaatactctgtataataatataatggtagatcattatatatttttccaaacccatagaaagtacaacttcaagagtgaacactaacactaatgtaaactatggaccttgggtgatagttatgatgtgtcaatgtaggttcatcaattgtaacaaatgtgccactcttgtagaggataataggatcactacaatcaagtagaatatatttcaagaatgcaagttgagacaataaaaaatccattaatataccatacacatagatccaaacagaaaaaatacataattatctccatacatgtaggaaatataaaacctttaatcaagtatatatatttgacaaaatataataatgatccctgatttaaaacattcaagaaaatattaatggatatttctttcttttttttcagggtcttgctctgtggcccaggctggagtgcagtggtgtaacctcggctcaccaaaacttctgcctcctgggctcaagtgttcctcccacctcagcctcctgaggagctgggactataaatgcacaccaccatgccaggctaatttttgtgtcttttttgtagagatggtgttttgccatgctgcccaggccagtattgaactcctgggctcaagcaatccccggcctatttctttaatgtaataaaatatgaatattttaatcttcatgccagcatttacttcatgaggaatcactataatgtttccactaacaccaggaacagagcaaggatgctcaccacttctttaacattgtactaggggtattacaatacaattagccatgagaattaacttaaaggtttaagaagtgggaaagaagaactaaaatgatctctatttgaaaattacatgatagcatgtctagaaaactctggaaaatcaatggcaaaacgaactaaaaaaaaagaaaccattaaggtaaccagatataaaattaacattgaaaaatcaacagtctttggacacataaacaaaaatctattagagaatataatggcagacaaaaccccttttactataacaacaaaaaaataaaatgcttaagaaaaaaatttaacaaaaaatgtgcaaaacctaaggaatgttaacacaaaaatagatctgaacaaatgaaagacaaccgttgttgttgaaaagactgagtcaacatcataaatatcccagggctctcttaatttataagtgtaagttgaagccaagaaaaatactaacaatattttttaatgaagctagatagattgatgttaaggtttatatggaaaaacaagaatgcaaatgtagccaggaaaacactgaaaaaagctcagaggacttaaaacctttccagacatctcaacacaccataaagtttctatcattagaacaaggtaggacttgtgcatgaacagacaaccactcagatggaatagaaaataaagtacagacatagatccaagaagtagaaatttagtacaatcatgtgtcacttaatgatgggtatttgttctgagaaacattttgtcaggcaattttgtcattgtgtgaacatcatagagtatacttccacagacctagatagtatagtctactacaaacctaagctatatggtatagcctattgcttctaggctacaaacctgtacagtatgttactgtactaaatactgtaggcaattgtaacacattggtatttgtgtatctaaatctatataaacatagaaatggtacagtaaaaatgtagtataaaagataaaaaatggtacatctgtatagggcacttaccatgactggggccaacaggatcagaagttgctctgagtgagttagtaagtcagtagtgagtgaatgtgaaggcctagggcattactgtacacttttatatgactgacaacacagtaggtttgtttacaacagcatcaccacaaaacatgtgagtaatgatgttatgaaggcattatatgacatcaccaggtgatacaaatttttcagttctgttataatcttatgggactagggttttatatgaggcccatcgttgaccaaaacaatgcatgcagtgtgtgactgtgtatgatataggtagcatagtttaaaataaactatgatactgaagcaaagacagattgtttaacgaatgattctgagaaaactgattagccatttagaaaaatgtgaaatgaaatacataaatcacaacattcacacacacaaaaaaaacttttaatgtatcagagacctaaatataaaaaaggaaactagtcaagaatcagaagaaaacataggtgatttctttaaaatctggatataggaaaaggttctctaatgatgactcaaaatccaaattccctaaaagactgacaaatttggctatgtaaaattgtaaagctgctttctgtcaaaaaacactacaaacaaagtcaaaagacaagtgacaaattgggaaaaaatacttgtaatagttatcaaaggtaaagggctaatttccctaatacccaaataattcttaaacatttagagtaaaatgaccaaatacctagtagaaaaatgggcaaaaaacataaacagacttttgcaagaaagattataaaacagtcctcaaacaaaaaaaagatgttcagtgtcacttatagtgagaaaaatgtcataattagagaaatgttgattggaatgcaattctttcagagaggaatttggcaatatctaacaatatcttctttcgacatagcaatccaattctagcaattcaccatgaagatacacctccaaccgtatagaaatacataagaagcacaagtttattcactgcaggagtgtttttcattgcaaaatgctggaaacaaactaaatttccatatgtaggagaatgattgaataaactgatacatccacacaatgaagtactatgaagctacaaaattacataaagagctccatgaattgatatgatttccaggatatatttttaaataaaaaaagcagagtgtcaaaaagtatctgtggtatgtaaccttttatgtaataaaaaagtgtaagaaaatacacatacatctgccccttaaacaagcaaaacatacacacatacacaactcacaagaaagatacaccagaaactactgagattggatacctcagggggcaggtgagaacactgaaaaagaataagaggatgaggacaggacagaaaggtagggagggtagtacacttatctaactttgtcctatatagctttgccctgtagaataatttctctaacttttctggaagaaagtacagttaaaattaaagtttaatataattatacttttaatatgagtttccttacatggttttaaagaaaaaaaatatgaattatttttctgcaccttgtagttatccatgaataaactcagcttaaccactgattacactactctaaagtggtaacggtggtggctactgaggaaggcttaacctctgattttagccttatagaatttaacctaattactcggtggaaataataatgattaataaatacaattgcaagatattttatgactgtaaaatatcaacatgtataattagttcactgggctaactcagattattttttctgtctgtgagactatcttctaagttacctgcccttctcctactcttatctcaggctccttcatatgctcttggtactataaaacttgtgcttttgaatcacattcaccctgtactgcaaaggcaatccagctctccttctctgttccagctcctgtgcaaattaaatgtcaatggaaaaaatccatagcaaagcttattagtgtctttcttttatcactttgtttttaaaaacatttatagaatgctatctctgtgccacgctttgctgcagtaaatagtagtaataattttcccaggctgctaaaacagaatcagatgataatttccatgcagagaacaaggagaatgttctgacttcttttgtgatcttataccttactgggttgaaagcactctcattctattggataaaggttctgctgccataaagaacagaaaaataagatgtggttctttattattgctgttaatcacctgtggagcaacccccaatgattctgattcaacatttttgagattggccctggcaatctgtgtgtgttttttctttttagtagagacaaagcctcactatgttgctccaggctggtcttgaactcctaggctcaagcaatcttctcattgtagccacccaaagtgctgggattacaagcataagccaccatgcccagccttaaaaataaaaaaaataaataaaaataaatttaaaaaaagttctacaggtgatagtgatgcccagtaaaggttaataaatcactttctatagctggcagttttattatcaaaaactaaaattactattcattcaaataagttctctgcttagataagtaaaataatctccttaaatcattgccctactggccaggtgcggtggctcacccctgtaatcccagcactttgggaggccgaggtgggcagatcacgaggtcaggagatcaagactatcccggctaacacagtgaaatcccatctcaactaaaaatacaaaaaataagcctggtgtggtggcatgcgcctgtaatcccagctacctgggaggctgaggcaggagaattgcttgaacccaggaggcggaggttgcagtgagccgaggttgcaccactgcactccagcctgggcaacagagtgagactctgtctcaaaaaataaaataaaatagaaataaaaaatcatgtccctactttcagcactgtttctccccacagtcttatgttcacacagcagccagagtaacctttgaaaagcataaatcagatcagatcatgcctctgccctatttaaagcctctcatggcttcctgctgcacttagaaccaaatccaaacttctcactatcctctatgagggcatacatgatatatctcctgcctacttttccaacttcattgtataccactttcctcttcattcattctgctcactccagttacattggcattctttctgatcttgaactggccaggcttttctgccttaggtctagacaatgtgtcctgtcttcaattatggtggtggtggtggtggcagctaatacatactgaacatttcctattaactacatgctgaagtgttttacatgtattaatgtgtgtaataaaacaactttatgaggttggtactattaatatttctgttttacagatgaggaaaggcccagggaattgaagtaatttgctcaaggtactcagactaactcctcaattctcactcagaagatgttaaccccaaaattctgtaattttcagatattaacttaaaccttttatcacccagttattaacaaaagctatcatagaagtatatatgtaggtctcatcattttggcccctaatagaattactttcactgaattatgctttcacattgtaacatccatctatactgaatagtggaaatgacacaatacaatgaattgctaccctccttttgaataattaatatgttctaacccaaaagaaaggagaatcatataactgatcatgtgtcatccttttggcagtgggaagatcgtattcaaatctgaaatccccttacaacaaaatgtacagagctttgtgactatatttcaggcaaaagcctcttacatttcaaactaaccaaaaactgggccagacatggtggctcatgcctataatcccagcattttgggaggccaaggcaggtggatcacctgaggtcaggagtttgagaccagcttagtcaacatggcaaaaccccgtctctactaaaaatacaaaaattagccaggtgtggtggcaggcacctgtaatcccagctacttgggaggctgaggcaggagaatcgcttcaacctgggaggcagaggttgcaatgagcccagacggcaccactgcattccagcctgggcgagagagtgaaactgtgtctcaaaaaaacataaacaaaaacaaacaaaaaaccttatccaaaaattaccttaaccaacaactcagaaattattttattagtccgcagtcactctctcacttacttttcaaagaactcctgcagctcctttctcctgcacagtccccttactcttgagatttagtttcaagactaagaaaacagagactatcctatctgacctctttcaacttctttcttcttttgaaacaaatccctacagttatgctgtgtataactcatttattttttaccttccttgctttcaagagaaatgaatttgtatataagttgtcctctaaatgttgcttcagctgcaacactcaagtttttatactgattcgttctcattcacttctaaatattttctaatttccattgtgatatttcttctctccagaccataagttactaaggaatgtatttttcagttaccaaaatttattttactgactttttattatcaacttaaaacttaactgcactgtagacaaagactgtagacttctaggggtgagtttccaggtgtagtatttttaaactttgttttaattcatctgttacattgcttcatctaatacctttatgcagatgattatataaatatgtatctctagtctacttttctgagctttaggcctacagttttaagactcttattagactaattttctatttctcctaaaggcctttgaaccctaacagattcaaagccaaaacattatttcctgccactctgaatctcttccttctcctcctcctccttttcctattttctatttttggaatgatgatccacattctacccaacttttcaagcaaaaagtgttcaaattgccttttattcctctctcttacaattggaatgaactgttttatgtattgtgaattatattttctagttctctctttaagctatcctttcctttctattgtcacaggacctcatcatcaatcccctgctctgctgcaccatccttctaaataacctttagttcatctccttggcactcctccttcccttcttctcttttatccttccccctgctgctttgcataaagcacaactctgataattcctttctcttgcttaaatatctttggttaacgcatacaggataaagtctgaatttagcacaatgcataagaccctttacctgagtaaaattcatccactatacaagcagaaagttttcaggcttggtttgctaccaaatatactatttaaaattcttggacctgcaagtttattaaaagcctaatgttgacaaggatttggataaaagtgttgtctcacatatagttgcctatgtactatatttttatgatcaagaaaaagttatgctccttgaattaggccccatttcccaaaacaatctagcatcagttcttgacagagtacaggttacatttttagccccatgaaaaaacttaatacaggtgaagaggaaggattggtactctgaaaatgctggggctcaggaccttatattagtggtgctaaaatcagagataatgagataatgttttcagtgttgatggatattatgaaattttaaagggaagagagaaataaataaacatctttagaagaccaagtagtaagtgaaaacatggcgcatgcatcctttaaccaagctttatgagaaagaagaaaaatgactcaaaaccatacttatagcaaggaggtaacatagccatttctagtgtacatatcacctgtaactgcagtaataataggacaatacagtcataataataacctttaaagataatgaaaattaaaatagattctgtatcctcagtatgacaaggcagtaaatactattcattccaggaaagctttcattaaaaatgattaaaataaaaattgtaggctcatatggagaagcttatactaatctgaagttttaattactcaatttccttcctatcagaatgctgagatcaatatactactgtattttacttcctattacctctctattggtaaaactagctacaatgaagttttgaagactctactttttcttttttttttttttttttggagacggggtctcattttgtcacccaggctgaagtgcagtggtgccaccccaggctcaagtgatcatcctacctcagcctcccgagtagctgggactacaggtgtgagccaccatgcctggctaacttttaaaacattttttcttttttttttttagcaacagggtctcactatgttgctagggctggtctagaactcctggactcaaggcgatcctctcacatcagcctcccaaagtgctgggattgcaccatgcccagcctgctttttagatttttgaactgtcaatacccaatgtgttttgaaatcatacagtaagtaagaataggcattttctaaagaaatcagccaaccttgaaggacagctgtgaagtaagaagtagatcttatggtttacaaagagagggagacagcatcagtacagcagtagtcttagaaactctgcctactactctgacactatgacattattgctctaacttatttattctgatgccaattattttctcagccttctgctgaatctatgactctaaattaaatatgtatgtacactgatatgtgtgtgcttgcgtgtatgtgtgtgtgtgtaggcacacacaggcacacacatatcaatatgggcatatatttttgaaactagagtgagcttcagaagtttcatctccatgtagtatatctttgactcataggtctgactcatagtaggattttttaaaatccaaatgttttatctcagaagcttatgttctatatagacttttagaaaagaaggccactgtatatcaaccattaaaccaaagtcaaaaattttaaagtatatacaaacaaatttgatatatgtactacagacttaattgtatttattttagaatactgtatgagatttaaatgatatatggatatagcaataattggaaacattttgcattaataattcagtggagtttctttcctgaaatttggttccaagcctcaagtacttgttattaatagctgtgcagaacaaataaatcagctgtgatcctaatcagtgtgaaaatgtggctaatgcacttttctgtttccctaggatccctgttgcatacctcgtgacataacagaaaaaatgtagtccaaactatttacggagatctaaactttaaagaggatctttcttaagcttgctatgttgaaacatgttttatcaaacaagtttaatttccaccattttgtttcaaatttattaactttccaccaatattttacctctggtcctggagggccagatggtccttggagtcctgggtcacctgtttggccctaaaatggggggggaggatcaaagtataaacataaacttaataaacacaattaaaagaagaaacaggcatatggtaaacaaatagcagtcagtcattatattatcatgtcaaacaaggttgtaatgactttttagaaaaatttgtaaccatcattactgtaaaagtttttaaataagatgtttatgggtttaatatacattcactcaagtgttaagtgatacaaacaaattaatgagtcaagtgctcaaatcaagaaaagaattgtatgtttatatgtgtttcacagagataagacaataaagctggactcaacaagatagggaattctagaggagaaactgcttttataaataaccacagtcccagggctgtctctgaaaattcctctctcctttgatactgtaagtggcctgaattagtaattaagactcacctggattgaaatccttgttgcttaatctctctaagcctcagttttctcatcaataaaatagaaataataattatagtactaacattctcaaagagtcattggagagttaaattagataatatatgtaaagtgctaagcacaatgtctgacatatgaagtactcattaaatgtcaaccaattttacaatcattattccttctcttcacaccctttctgctttcctggctcacacatagaattcctagactgttttcatcctttaattgaagttttaaggattcagtttcagtatctctgaagctagtttctgacattcatgataaagatgtgaaatcagggttaaaggagaaagtgacaggaaagagaagtaggtataaagcctgaaactagagaaggctagcaatgctctcgagagatgaaagtttggaaagggaggacagtagtctgatatatccattttcataagaaaaactattgcattcattatttctgtcatattaagtttctatatgagcttcaaatttaatttaaataagcctcagatcacctaaacttgcaagttacaatacgggattgcccattttccaaaacctaaagcacagtttccaatatgcacttaattcattctcagtgctgaggtatctggacataaaacaggacaccataaactactgcaatcaaatccagagaaaggcagtgaaatattatggaaaggctcatttaagtttccctttccaaataaacaaaaacaaaatctgtgatccatcagaatcagtatactgaagttcttaaaatgacaagcatctctctttaaagagatagagaaaggggcgaggggctctcattggagccctctagtggcaaaatccaaccacaaagctaaatttctaagcagtgaggataaaatagcaataccctagggctttgttttcagaaaagctgattgacaatcacatatttaaaaacagaaattgtgtaatgattttatttgatcttcagaataattctttgttttgtaaaattttgattgcaaatttcctatgaatgtcaatttttctttataaaagctgacattttaagtaacttatagataactaatattaaataaacctctacaaatgacaaaaatccctagctaaaaaatggatagggcataacaattgtgtttgttttcttggtctaaaggaaagtgtatttacgaacaacctcagagtggtagttttctctatttttttttaaaatacttgtagagcaaaagcttccctattcaagaactgtaacaactttccaaatcaggacattccttcttatatcttgaaaatattatttcatgttacaacttagatctacttggaaacaatattagttagtaacaccaacctcttaggtaacagaaaattaaaagtaggatctataaaatagggaagacatccttatgatgttggcattctttccacgacagtaaacaaacattttagataggcattaacttatataattgaatgtgggagtttgtttcttaatataataactgattctgcataagcaacttttcatcaaacaagtgtctccttctataagaaggaaaggtttcctggtcaaacacctacagtttttctattaataatatatacagccaggtgcagtggctcacacctataatcccacattctaggaggccgaggtaagaggattgcttgaggccaggagtttaagactaacctgggcaacaaagcaagacctggtttctacaattttttttttttttaattagctgggtatggtggtggacctgcagtccttgctacttgagaggctgaggtggaaggaccacttgaccccaagagttggagactgcagtgagctgtgatggcaccattacactctatcctgagcaacagagggaggccctgtctctaaaaattttttttttaattaaaacaaaaagatacaaacaagtaataaatacaacaagagacaaaatacaaggctatctcactaattttaattcatgaatgcttatcttatcttcggcccaaagtagttttcaaaagtttgataaaacaaataaaaaaaaatcaattatctccctaccaaagtaattcctgctgacattaattttctttattagaacagtacagaaaggtgtaaaatgagtaagtaaaagcctcactctcactgtctcttgctccctgccctaaaagaacatcattagcatttattgtgacttctttcaggaaaaaaatactaagggctttaagataatgtgttaaaggtgaaacaggctctctgccttttctttagcttacactaggaggaatattagtaagtactatgtctaaaagagaaaaacatcataatcacaggactataaggaaccttacatatgatatggcctaaactttcttttttcattctttcttttttttttttttttttttttttgagatggagtctcactctgtcgctcaagctggagtccagtggcgcaatcttgacttactgcaacctctgccttctggattcaagcgattctcctgcctcagcctcctgaggagctgggactacaggtgcctgccactatgcctgggtaatttttgtatttttagtagagacagggtttcaccatgttggtcagggtggtctcgaactcctgacctcgtgatccacccacctcagctgcccaaagtgctgggattacaggcgtgagccaccgcacgtggccctaactttcattttaaacatgagaagctggtaccatggtggttaaatacccaaggtgatagccagtaggttaagtgccagagctgggaccagaatccaggtctttgtctctctagccaatgatttttttactcccatcaacatgttataaatataaatttaatcaaagagtaaggaacactaaaatggtttgccttgtgtaagcacgatacttgactctagttttctcaaaaaattaattgtaaagcacaaaaaaatacttatattatttattagttaatagtgcccttagagcatgtattgtatcatttcatcctatttggtcaagcgctagaaaaatgtcacattatttaaaaaaaagaatatgtaaaaagtatcttattttgccaatcactgcaaatatcagagagtctttatatggtttagaaccatccttgaaaaacagaagttgtttgttagcttcatgacctagtctcatgatccaatttatgcactctagagtttctgagattcaactcaagggtacaagggagggtacacggcttattaggttaagcccttatggcaataagcccagggcaaagaactagtataagcaaaggtcaccactaacatttcatcgaatagatgccaaaaattgttctttgggttaaataattcctaagagatgtatataaaatactgtcactgttagaagtcacaaagaatggggtaaagttctgtaatttaatactgcttcctgagattaaaaaaataaataatcctgagatggaagggtagagttagagggaacacaatgaactgctcaggaacataacacaattattttttaatgtatattttaatgtgacattaataaattataatcctatatgtattttttgtatgtataatcatctctacctttttcatagaattgaatcctatatctaattttttctatctgtaatcacctttaccttcacagagttgtaatcaatattaaactcctaaaaccatcttaaaatattaaaccctaaaacagtatggcacagtagctaaacgcatgagctctgacatacctgattgcctaggtttttctgaatggtcacctactaagtaggtggccacccaggtgaccttagatgttttctaacactgtgtctcaattttcttaatataaaaaataggaataataatagtaccaactttgtaggattgttgtgaagattaatttagatgtatagtccttagaatactgcctggtattgtgtagatactcagcaaatgttagctataataattatgatttttaatatttagaaatatattttctcaagttttaaccattttatttaaatagctttaattattaagtaattttagatttataattttttgagttttatgttaacagcaatataaggtatctttttctttcgtctaattgatgtccaagggtcaggaaaaaaaataaggatttagaatattttggtccacaagagagtgcaaacatgctaccttttcttcagactgtttccttaataaaattgatattttgaaaagttaaaatattatttaaggtgctttacattttctggcttcaaagcctattgttttaatttaaatattgtctatattaaattattcagtagaataatatgaccaagatctttaggactctcagaaacttggctttggcctagggttgggagtagagggaagtccaaaagtctatggaatgtgaactgaatacctgagggatttgctatattctaaaactaaggagacaaatgctcagtaggcttataccctacttagatcaacagtgtcgagactcatgccatgacatgcactctgtcaattacaaagagcaaagcaaaagttcaaacctactgaaggccctgactttcctctcatccctggtggtcctggtaaaccaacagcaccctaagagaagagaataacagaagagaaagttattataccacaaaaggcagacataccactatttacaaactgctaaaaaatttcataaagtatgctaaaatattgagacaaaagtttcaaacaagaacttaaaaccatattgataccacattctaacacaatacatggataaaataataagcagttctttcttttgaatttacactttttcatatttacataaaattaatggtataaacattaccttgtctccaggatacccgggttctcctagctctcctgctgtgccttgttcaccctggaaagcacaatttcatgcaaagatacttatgtatcacaaacatggcaatattataagaaagcaaatattcattgtagaagaataatttctctatttttcttacttctgaggaaaactaatataattgatactacaaattagactccataaaaacaaaatatttcataaattgtgttgactgaaaagtaaaagacaaatgtgataaaaattatttttataatattaatatttaaatcaccttatcacctttgattccaggtagtcctttattccctgaaaggccctacaaaaaaaggtgacattttgtgatatcatagacagattaaagggaaatatccattatacaaatagaaccataccattgggccaggaattccagcaggtccaattggtcccacagggccaacactgccctggaaaacagtaagaaagaaatgcatcattaagcattcattaggattagaaagaaaatgtggcagaattaataaattaatgaacccaaaacagccaactcactaagctcctacacgtgccttgttcttcaacaacttatttttctctccacatttataaatcataccaatatttcaaaccttagtgaagtccatcatttttctgaaaccttttcatatttgtctagtccacagagattctttcctcctttgagctcctataatactgtccatgacattcatcttgcaatatttctccaactagatgagacctttaaaaaatattttagtgccatattcccaggaactagtcaacagatacttcatttgattgtcttagagttttatttcacccacttattcagcaaatattttttgaggagttactatgtgccagacatcctaatgatttgattttataatttcaaatttgcagaatgagaaaatttatcataatttcagggataaactcagaggcaaacaaaaagctctactcttctgggcttatctcgtttattcatcatttaatatttactaagcataatatgtacgagacactgttgaagaaaaaaagagaaaaaagacataatctctaacatcaaggttctcaatttaatgctctaattcttcagaaacattaccactattatcttctgcaagcaagagacttagaaaaaacttcaatatgtcatcttagaagacaaagggcaatagcaacataagggtatgaaagaaaaatttgaaaaacaaaatggcacttcttggtggtttgggatcagttataatttctgtgtcactgaggtctcctttttcttctttttctcacgatctttctttgcctggcttccttactactctttataatggaaatccaagttagttcaaacttctctttctagtttctaaatattaaggaactcttaaagttgcatttgtgaaatgctaagaatgttacctcttgtagttagaattctaatttcttaggatagcatcctaagccctctctattaggcttccatcaaactttccagtctcctttccttccattgtcctcatttcccttccactttacttctccctccccgaaatcctccattctagctgcagtggactgtctttcattttctgaatagctctcccttaccaaatgctcagaacctttgacaagacagttaccagtactagaatgcacttctactacgctacttagtacatggcactgtactttttttttcctgccttcctagtctgtgcattttgtgacagcggaaacacgtttcattcattttttttatttcccagacccaacataataactggcagataatggttctgaaataaagtgtagaatgaatactgaagggattaatttgaaatggtgatttctagagctcaatatcctaacataacagcatttctaattgtctacatttatataatacaaatttcagaatggaaaataagacatcatatggatgagtcttaaagtctgtgaaatacagctaagataaattatttctaacatgtttaatcctgaaatatataacaccgttagaggcaaagggtaatactttccaacttaatagatatgcaatattaatacatgatgcttgtaatttcaaattatgtcaataggaaaacttgtgcttatgattacagtggctagtttattcaaagttcatagctttaaaacttatgataggttagaaaaatacaaaaatatctctgtttggaaattatgcaaaagtaatccaagtaagtatggaaaggactatcttaacaaacacacacacaaatctttctttgtgtccttttgttttcttcatagataaaataatattcttaacttttttcagtaagtatattactagcatcttcagatgaatgtactttgtatatataatatcctattttacttttcagtgactctacatgaaaaaatcacataacagtaagtattgggagatatgaaaaatatattataatgaacttagaaaaataaagaactataaagtaaaattgaatactatggaattgaaatttccaagaaacagcatgtcacaaattgagtggaaatcctagtcctgagaaactatagccttctgaaagcaactcagttctcagttctaccaaggtaacctgaaagtccttcagcattccctaactaccaactcatcttccataagaacatggaacagacagaagaaatactttcatgcgtgggagccttgttgagggtgtttgggatatggcatcagagacagaggagcctcccacacagctcctctgagaacttctgagttaagtcaaagaaatagagagacccagaggataagttatttgtattaaaaagagcagtcactggccaattaataagggttcatatggtatactgtagaaaggactgtgagttccacatggtgcttttaaatcacacccaccatactcacacgtgatacacattgtcactagtctaagaaagcatataacaatgacaaccaactgcatggaaaaaataatttagataaagcaatagcatctcttatcagaaactatacctgctggaagggaacacctgagagataaagcagaggctgctgctccgggcaagcagacaagttgtttactatgcaatataaagggtcttcataatccttcccaattactttcaaaacctcaattccttccattctgctcccaagcccttacttcctatgctacaatcccactactcctctttccagtcccaaacattcatttttccccatcttctgtgtatttgaacacagcatttttgtacctaaagaaagcttttccccctttcaccccaccccattcatatacaatcttcaagatatagctccaaaaatatctcctttgtgaagcctactctgactttctgagataacagaaattgctccttttcagtggttttacatttaatcaattatagcagtaatcacagtatatgacactacttatttttccttctatgccattagattgtaatgttgccaaaaataggaattttaacttgttcatattattaggcctagcagttagttcagctatttagtaggtgctcacattgttttaattttaaaaagtaatgaatgtaaaatggaagtaacaatacctgctttatctactttacaactcattgaggagcaaataagatatgtatataaaactactttgaaaggtagaaaggaccatctatatcagtttagaagagatgaggactacaaagatgactcttactatctgatatggtttgggtgtgtccccacccaaaatttcatctgaattgtagtctccataatccccacatgtcaaaggcaggaccaggtggacataatcagatcattggggaggattcccccatgctattctcatgatagtgagtgaggctcatgaaatctgatggttttataagcatctggcatttcccttgttgcactcactccgtcctgccaccctgtgaagaagtgcctgcttctcctttgccttccaacatgactgtaagtttcctgaggtcaccccagcaatgcagaactgtgagtcaattaaatctctttcctttataaattacccagtctcggatatttcttcacagtggtgtgagaactggctattacagtaaactggtactgcagagaatggttgctgctataaagatacctggaaatgtgaaagcaactttggaactgggtaacaggcagaggctggaacagtgtggagggctcagaagaagacaggaagatgtgggaaagtttggaacttcctagagacttattgaatggcttttatcaaaatcctgatagtgatttggacaatgaagtccaagctgaggtggtctcagggtaagatgaaaaacttcccaggaactacagtaagggtgactcttgctatgctttagctaacagactggtggcattttgccctgccctaaagttctgtggaactttgaacttgagagagatgatttaggatatctggcggaagaaatttttaagcagcaaagcattcaagaggtgtcttggatgctcttaaaagcattcagttttatgcattcacaaagagtttggaattggaacttatgtttaaaagggaagcaaagtataaaaaagttcagaaaatttgcagcatgagaatgcaatagaaaagaaaaactgattttctgaggagaaattaaagtcagctgcagaaatctgggtaagtaatgagaagccaagtgttaatccccaagacaatggggaaaatgtctccagggagtgtcagagatcttcacagcagccccctcctatcacaggcccagaggcctaggagaaaaaaaaggtttttgggctgggcctagagccttgctgctttgtgcagtctcaggacttggtgccctgaatcccagctgtggctaaaaggggtcaacacagagctcaggccggtgcttcagagggtgcaagccccaagccttggctacttacacatggtgttgagcctgcaggtgcacagaagtcaataattgaggtttgggaacctctgcctagatttcacaggatgtcaggaaatgcctggatgtccaggcagaagtttgctgcaggggtgacaccctcatggagaatctctgctaggacagtgtagaagggaaatgtagggtcagaggccccacacagagtccccactagggcactttttagtggagctgtgagaagagggccaccatcttccagaccccagaatggtagatccacgaacagcttgcaccattcacctggaaaagccacaggcactcaatgccagaccatgaaggcagctgggtgggggtctttaccctttaaagctacagggtggtgctgcccaaggctgtgggaacccacctcctacatcagtgtgacctggatgtgagacacggagtcaaattgagatcattttggaattttaagttttaatgactgccctacttgattttggattttcatggagcctgtagcccctttgttttggccaatatctcctatttggaatgggagtatttacccaatgcctgtacccccattgtatctaggaggtaactaactgctttcaattttacaggttcatagatggaaggacttgccttgtctcagataagactttggacttagacttttgggttaacgctggaatgagctagaactttgggggactgtcggaaaggcatgattgtgttttgaaatgtgaggacatgagatttgggaggagccagtggcagaatgatatggtttggctatggccccacccaaaatctcatcttgaattataattcccataacccccacatgccaagggcaggaccaggtggacataattggatcatggagatggctgccccatgctgttcccatgatagtaagtgaggctcacgagatctcatggttttataagcatctggcatttcccctgtttgcattcactctgctaccctctacagaaggcacctgcttttcctttgtcttccaccatgattgtaagtttcctgaggcctccccagcaatgtggaactgtgagtcaattaaacctctttcctttataaattacgcagtctcaggtatttcttcatagctgtgtgagaatggactaatacagttatcattagccatttccttttctgtagaatctcttcccatgaactgaaaggtgaatggagaaagagaaaatacagaagatccacttatttttactgagtacttttatgtgccagacagtgtgctaagttttggagcagaaaagtagagatagagtgtttcaggtagacaaacatgtgcaaaaccttgtagcaaagatgctgcatagcatctgagaattaacagctttgctagtatacaaatagtatgtcatggacatgtgggtaagaactaaaccagactagatatcttgggccatatttaaaaaatttggtcttaatcttgacagtaacaacagaagctttttagctaatcaactccatgctaatagattaaataaaaactgcatgaagagcatctttggaatctaactccttttgcctacttccttactctacccactgactaatatctacaggtttaaccctattctaagttctcaggaaaaaaaaaaacatcacacagagtttctcagaaaggactaaagaaatctcataaggtagataatatacacataagggagtataagttttaaggaggtggtacagaccaacgaaattctggactctggatttagatcacctggcttcaaatctgggctcaaacacttatcagctaaatagtcatgggttggtctgagaatggaatgacttaacaattgtggctagtccactgaaaatagtaaacaaatgtgaggtgccctcagtaattttattattactactactacaaatcttaccattatgttagagaaaagtttaaatgtttcagactcacacaggttctttgactctaaatcccatactcatgttatcccaagatggcaagttaaagcttatgctgacttaaattttaccacagttccaataactaagctcctgacttatttatttttatttatttgatttttttttttttttttttagagagatggggtcttgcttcatcacctaggctggagtgcagcagcatgatcatagctcactgctgcctctaactcctgagctcaggagatgctctcacctcagcctcctaaacagcagagactacaggtgtgctctacctcacttggctaattaaaacattttttcagctttatttttatttttttcaacgttttttatttaaataaggagaattcttccctatggaaagagctagcacaatcacatatttgaaaggagaaacaataggtactgaaccggagggaaagggcgaaggctgagtgtaccagcaccagcctggagaatccacaattccacttcctatccaaggtaagtttccgaaaatagtatataaacaagttgcacattatacctttagccatcatctgccctttcaaatatctggtctacatgaaaagagaaagaggaaaggccaaaacgaaaacaaaaggaaacaaaaacaaaacgcaaccctctcaaaaacaaaagaaaaaaaaacccaaaatcttttttactacacagagcataaggtcaaaaacttacagtaccagtgtccccttcaagccatggaagaaaaacatccacataaagccttagcaagaatttccactctgaggctttgtaacatgctgaagacagggccctgggggtgctgctgccattttggaggccaccaactggggtggagaatcagtgaacagcacgtctcatgcacttggaagatcaccagccaaatatgcactggtggcctggtggagcatggctaggtgactgcctacccccaacactgaaccactcctatcctggatgacctacttcttaggtctgtctcacatttcacaaaagagctggaagtctgcatttctcattcatcacaaaacaggacaaagcacacacactctagtatctttggtcatcaaaggccatttccaacagaccctcaaacccacgtttgctttgcaagaagtgaaaagggacaaatgaagatttgaagggcagcctgcagccacttggcagaaggaaactaaatggcagggagggggctccaccagagctgccatgctgccacagtgggccaggctaattttcttttttctttctttttttttttttttgttgttgttgttgtagcattgggatctcatcatcttgcccaggcttggtctcaaactcctaagctcaagtaaccctcctgccttggcctcctaaagtgctgggatcataggcatgagccaccatgcctagccgtgacttctttgaccaagctgtcaccttgtgctttgggacagctaaaggtaagggaaagaagactgaaagaaaggctatcagcatactgaacagatatttgcactcccatgtttattgcagcactattcacaatagccaaaatacagaatcaacttaagtatccatcagtagatgaatgaagaaaatgtggtacatacacacaatagaatattattcagctataaaaaagaatgagattctgtcatttgcaacaacaggaatggaactggaagacattagtgatataagccaggcacagaaaggtaactaacacatgttctcacaaatatgtgggagctaaatatatgagaagggtaggagtgggggttataaaaggtatgataaataggtacaaaaatacagtagaaagaataagatctagtattccacagcacaacagagtggctatttttaacaacagttgatcacagatttcaaaataaaagagtgaaattagaatgttcctaacacaaagaaataataagtgcttgaggtgatacaagcaccaattattcaaatttgatcattacacatttttgcttgtaacaaacatcacatgtacccccttaatatgtacagctattatgtattgaaaataattaacaattttttaaaaaggaaagaagagggtcttctatgtcttatgcttttgaggaaactttgtcttaagtatcctttagcgcacaggtacaaatacatacatataggtctataaaaatatatcattattttttcttatcataaaatacaattaattttttgacttatactactggtctaattattcatatctggttgaaaaaaatacatttaatcaaggttgataaccaacaatgacagtaaaacctctcatttccctaagtttcaaaaacacatctaacacatataaattgcacaataaaatattttcttaagaatgatgatatttagtgatactcactctaagcccaggaaaccccggaggaccagtgccacctacaagtccctattgtaaaagaaatttgcaatacttattaaatttgattcccaactactaagggtatttctgaagataaacacaaaactttctagctaagaatacatcaaaatgtaccttctactatagctaacttctgaaactcccctaatctatgcatcctcctgagaagcacaaacctatggtggccatttatgttcttcacaagtgcccttggctaaatgcttttggatgccaggactaccacctagcttaagcagagtcccctctgcctcctatgtatttaaccaaggaagtaaatcctatcaataatcaacactgtacacttaattatgctatccattctatgaaaagacaggtggtcagcacgtagggttagaaaaacattttcagacggtttaaaacactatggactcttttgaagtacattatttaaattctctaatcttcatttttctcattaaaatagaaataccaatatttgttctcactgtaaatatcacaatgaaatttgtcatatgtaaaggcaccataaaaatgtataaaattttcaatactgttaaattatttatataagtatcagatttttcatgatcattattaatttttccagctgatttgtgattggtcttttgaactcattgtcattacactttatagtctttaagataattcctaattcactttatgtcactgtcacattatttacaaggcacaaagtacatgaatgtccttctttttttgcatttcaaattctgtttggaaacaaaggcagagaatatactatagagaattataaaccagtaaactaaatatatccagttgactattgtattttaaagattttaaaaactcaaaatgctcctgaagaaatattattatattttaaatgaagagcagatttcaaaaaagaaaactttaaatattctaggagtcttaacagacttcatggatagtaactgacaaaaaattatgtaaaatggcttcacactaggtacacaagtgcacaaatggcattaaaaataaataatgtctactttattatgcttgaaatgggaagctcctcagaatcatatgcaagaaaaatggtaaacattccacttaaaacaacattcaagtttttaacaatttatttgaaaatcagttctacttttatctgctatgccttgtaacaaatgcagtcttggctgaattcactgaatgagctaatatagttttaatttggaaaagagaagtaaaaaagaagaaaaataaactattttaaactcttcatgctagtgatttacttacgtgtaattattggaactattcccaatttaggctacagagattttgtgtttttttctaactcactttaaaatcttatgaaaagaatatgtgaatggcttaagattggggaatagctattggatggtttttaagagcaaaaactaaagcttttctacctagcgccaaaaaatagcaatccatcatcattctttgatgatataattaaactaattttagaatagtaactctttctcaatctgaacattgacagctaaataatcccaaagtagaataattttctataaaacactaagaagtaaggtggatcaatgacaggtttgagtccaaagagcaatcgctgagtgtaaaatttttatataaggcttgttagtactttcatgtataagagacagtattgtgatcacatatttttaatattttacttaagcagttatacttaacatcatcaaaataattaatttaaagattgaatgtcatgatgaaatttgaaatatttttggttaatttcctaagctgaaaaatcacaaactggaatgtgcacagtggtgtggagattgtttttccaatagtgtttattcacaaatatgataataaggactgtaagtgcagtgctatgaagtatgaatgatgttagaatgcaaggctgaaccaacataatgtactcacaggactgccatcaagaccagcagggcctctgtctccaaagtcacctggaaaaccctgtcacagggaaagaggaagaatgccaacatatataaataattcatttttgctgtattttctaacaaagaatttagtaatagaaaatattaatttcctaactcttaaactgtaatgcaacaaacattcttttgcataacacgcttaattgattttaaatacaatatttcaaaaaataaaaaacgaaatacagtatttctatatgttataaaaattattttatatgccacataacatatacagaaaacaaaattggagaagtttgttcatcatacataaaaaatcaccaaatgaaaggaaaaacaatgaagatttctggctgaacaatcttcagttatctctgctattccaaactattcctatactcaccccatagagaataaaatagctagtattattaagcacttgccatgtgctaaagggtttatgcacataattatatatacacacttcatttcatcttcataacaggtctattcaatagatactaatattctcacattgttgttgaggaagttaaagcacagagagtgtaggtcacttgctcaaggttagaccattaaaaatgggtgggactgagatgtgaatggaggcagaccgattctagagtccatgtttttcaactatgctatactgaatactttaaatcatcattccaagacatacatgtaaaacaaaaagtcctttaagtacagttttattaaggaaacgaataatacacataaatactacaaatttaaaatgaggtgaaaattaaaagcttcccaaatgcctattgagaattctgcatggtaaaactatgaaggatggtaaaataacaaaccttctcattataaattctattgtaaaataactcaacgctcagctactcttactttacaatactacatttttctctaaagatttaccattcctcaactttaaagctcactttttaagaggctattttataaaaatgtttataagacttactattgtaaacattttcataatattcatttacaaaaactaggaataacaaaaataaaaatctatcattagattcttataatctctttacataggcaagtcagtattaaatattatgtttaacagactgccaaaaattactggttcccagagcaaatatgaataggttaaacttaaaagatagtttaacaatggaaaaaatgtacaatgtttctaaaatatagttaactcctactagaagcacagtttctcttattctgtaatcaaaggataatgtaaaaaccatctgtgtagtcaaatatattgtagccatactcccttcaaagtcagctgaagctcaagcattttactttcgttgtctttggaagtcaaattttcttgtcaacaacttgcaaatctgcaatatattatcctattcagtatgagctaacatggatacttgaaagtacttatgacacacaggtaatggaaaaagtagaggaaatatactacagtaagtctgaaacataagagatgattgattttttttagatagatcattagtaggttttccagaaaccccagtgaaataataaagtgtaggggacacactgcatgattccattactgtgtaatgtccagaataggcaaatccacagggacataaagtagattagtggttgcctacggctggtgatgtgggggaggaatggaaagtgattcctaatgagtacaggatttcttttgggggtgatgaaaatgttataaaatcagatactgtgatggctgcacaattctgaatatactaaaaactgccaaattatatactttaaaggtgaattttatggtatgtgaattatatctcaataaagttgttcttaaaaaacaacctgaacaaggagtgggattgctgaaaaacctttgggaattcactcaggattgcctagagaatgtgctgttctcccaatccttcccagtcccttgcatccagtgggagaaactgttctctggctcaccttccctcaaaatgagtaatttttccccacctaggagagggaagatgagaaagagaagaggggaaagaactgtgatcagttcttcccttatcacaaaatacttactttctacaaccagcagaaaaataatgcaatattcattaatttcaacttcttattcttccagtagttcacaaacatgtgtattggttgttcaccttgactttgcccctgaaataatttaattgaatatctactttaaatttttaatgtatttttctttattattattattatcgttgtcgagatggggtctcactttgttgcccagactcttctcaaactcccagcttcaagtgatacctcctgcctcagcctcccgtagtgttgggattacaggcataagccactgtaccaagccgttgtgtattgtttctcttctcactttattactcattaaacatttcattttaattctctattcttgatagagataatttattcttttaatccctcatatgttgatcatgtattatcaatttttgaaataatttctatgaaatctagacacttcttgttttatgaaatattgcacagttaataccacaaaggcattatttggctccttattagacacataatattttcttttaaagaacatcataccaatgttttatattgttgaatatttccttgcttgtttaatgtttattcagttgtttttcaatgctaataactgcattaatattttaatacaggtgaggttctatattcttttaatcatgaacttaatgtttgcagccacatagcttcattgccaaaaaatggtcttcaagattggttgtgaaatatggaacagtagtgacaaaatacatatctttcctttaattttataatacaaaagacagtctctataatttctttctccagttgaaagaatgttgaagaatgaaatattttgttatattttcctggtagaaaattattatcattaatttaaatcaaattgtgttttcctaaaaatactctcacgttgccaaaggacaaaatggccatttagcaggattatcatgcaacagagataggaaagctcaagagttttgcttttcttgttcaatttgccagtttcacaaatgttaactttcatcttctaatgagcatgccagagtcacattgttgcttctgtgttgtatatagttctcttcttcacattttgatcagttaaaatattttatgtgatgaagaatatgatgtttcaggaatttcaaaaaatctcttcaagttgtaaataattttctattttctcatttatttccagtgatcagtgtggtggacagtttaaaggatctccaaagattcccatttcccagtgttcacacttttctatgacatcctccctttgagtgtagctagcacctatgacttgcttcatctaacaaatagcatatagcaaaggtgatgagatatcactgccatgattatgttacactatataagactgtcttagcagcctggagctagagacttctcttatgagtttgatgaagtaagcagctgtgttggagaagtccatgtggccagaaactgtgggtgactctgcaaactctggacagtctataggacctgagagtggcccatagccaagagccggcaaaaagccagagccctccattctacaacctcaaggtaataaattcttcctacaacctgaatgagtctggaaatgaactttaccccagtcaagcttccagatgataatgcagcctgtctgacactttgattgtaaacttatgaccagagcagaagactcagttaagtaacacctagattcctgacccatgaaaactgcaagataataaatgaatattgttttaagctgctaagtttgtggtatttgttatgtatcaatagaaacagaaaaccaattaaattggtaattaaatcttctttagagaatatataatgtcttatttccaaattttaccataggtaatgttcaatataagtctactgttgtttctagttttaaaaaacttagatcatctctgaagattttctactgctgtctactttctattacaaattataataacaaaaagtattacaatttttatatttacttttttgaaaatttgactttatcttgttaaatatctgtattttaaactttatcattccagcattttatgtccacctgtcgccaatgtaaaaaaaatcttatcatgcttcatgaattttgtctatacttatgtaaagacaaatttaataataatatgcattgtttaataatggaaaatgcttgtcagtctccaattgcaactgtttgcaaatatcacactaattctattacctcaggaagaataaatcataatagaaagaaaagataatagaagcttaaaattaccagaaaacagtatttttattacgtaagattctattgcattcatgctgagagaaaaattagataattaatttctctttccttttatcaaaatgcttctactgcctgctcgaacccttagcacaatcttgagcagtttctgtctccaatgtcagcaatggtaccacttaaaaaccttcatggcattcagacatgaaaatacaggcaagagatgtggagaatttctctgaagcctaaacattattaaactgtggtacccagcctcaatgatggacctcagtgatctttgattcccggtattcatgctgttatgtagtccagacgcaccctgaattatgtgggcctatgtgaccaaaagaatatagaagtgacaatgtgtaatttctgaagctaggtcataaagatactacagctatcaccttgctgtagtatctttacaccactcactctgggggaagccaaagctatgttctgaatacattcagcagcactgtggagaggtctccatggggaggaagtgaggcctcccatcaacaactagcaccaacttggccagcaagtgagcctccttaaaagcaaatcctccaacccccagtcaagccttcagatgacagtagccctaaccaaaatcttaaccataacctcatgaattagaaccacccaactatgccactaccaaattcctgacccacagaaactataaaaataatacatatttattgttgttttaaaccaccaacttaatttgtttcatagcaatagatagctaatacatagtaacaagagtgactgtctaggattatggggcatgtgatgccagtgctaagtgctggatcctgaatgacagaggcactcaagtattttaaatgtatgatatgcaggggccctctaaagctcagagcccagagcaagtttctctgttgcctgggtctaacaatggtactgttatcaaacatggtagttattaaacactaagaccaaaagaagtttgttagacttgataggcctgaatacatgtatgtgatattaatattttagatcactcatagatactacatttggtagtctatttaaatatgtttaaacagtggaaaacttcttgcttagcatgtccagtaaaagcattattttcctagctccacaaataatatgtttaaatgtatataaaataactaggaaaataagaggaccaagataaccataaaatggtcacaatgactatatttacagaatttttaaaaaacaaaagcaatacaaaaacccttctggagaacatattttgttctttctagaggaaggtttagaaacaacatatttaatctgaagtagaaatgaataaaaattatcatagaaggttatatactaaacaagcattaataatcataacagaaatcatttgttccaaaactaagcattgaaaacacaggatcagactaacttgtctagaattagaaacactaaaatttaacctagaagttatttttacacattctgcatatgaatacatattaccaggaaattctgttattttaaaatccctcaaatataaaacaagatcactacaggaagaggctggagtgtgaagtattctgtgatgatctaatcttttcacccttcttttcctcacagcaaggacaatttgatccacactcagggtcaaccctatcctcataattgagactaattctaaacttcatcagaaacatgagtaggtttggcccaattcatgggggtttggcccaattcatggagatttggcatcaaggcaggcttaatgctaacctgggcctcagttcccagattcaagttccggccttgttcttaaagactgaataccacgttgtgtcctttttcttgtgtccaaaaaccagatgtggtatacaacatcatgttctgtccctcaataataagagtcccaccttattcttgccatttgccctcctagagaatataatccctgagcccaacctaggcctaactgccatatatgcactcacacttctgattttgataacctacaaggctcttttttttttcttttcttaattttatttattattattacactttaagttttagggtacatgtgcacaatgtgcaggttagttacatatgtatacatgtgccatgctggtgtgctgcacccactaactcgtcatctagcattaggtatatctcccaatgctatccctcccccctccccccacccctacaaggctctttgagttgtcccttatgttatccaccctgaagataattgccatattcccatccattggtgtcacatctctatgaaatcaattatgttctgcctggacttcctccaaattataacatgtagttcattgggtgtccttcttcttagtgtctatgccaaccctgtggtggggttaattcaaagtcctgaaatcttccatacaccctgtcatactacagttagccaaatatagctactacagactatgcccagtaaagtagaatccagaaaatacatttttcctgaaggaggcagaatcccttaagaattaataacaactttttcataatgttctagctagagttgtactttatgatagaattaactgcattcttttcctaaaacaaaaacaaaacaaaataaaaaacactgtctctaaattctccacaaaatgtatgtatctgagatgctactatgcaatatgtatttaagactgtcttgggctaaagataaaaactaataacagatgtccaacaccaggattttatattctgaaattctaactctagatttagaagccaaaatacagtttacttcaaatacactcttctaacagaaaaacatatgagaaaagaggagcaggctctcctttctatagttagaaaagtaaacatctctgaagtctgggtgccttaagggtgttattttgcccaccattctaggctgtgatatttttatcttcagaggaagaaaactaagtacagttttgctctttgtcaaactttaaatgtaatgtgatttgattatttataatccattctaagggtctgaaaaattccttgaaaaacatcagcattcggatagcagttttctaggtgttgttgaaagcaattcccatctccaatttcatgtttattttcaatcctggcaagtcagttctagcataaattttttaggtctgtggagccatataaatttgcatggctaacttggtacaagacagagactactgattaaatcaagctgagagctctgtaaatgctttttttaaaagcaactatagaatttcctgattgtagcactacaaaataaactttggaaactttgcactaaaaaggaagctacttggagtgaggtataagaaatctaaagttatcaaatacataacaaatcccctctccctgcctcccctattttttttaaacaggattcttcttttctgttatgaatcagtgtacttaggcttttaaaaaatctggctcacatcagatatgttccaagaagattctcaaataaagacattaaagcatgtaaaacaaaacagtagtagttctatggtgtttaaaggctcctgaccaataaaggttgtccactgtcttgtcttttcctgaaatctccagagaatgaacttgagttgaactcaaatatccacagatagagagcaaaaggatgaatcaataatagcctcttgagcttctctatcttcaacagttagttttattgaaggcacagagagccccagggtatcctctaatattaattaataataagggttttgatccaattgtgacatgtagggagtgcaggagggaaggagaggaagaagtcagaactacacctcgctatccaaaagcatgagtatacacatacattgactaatattaactgtgattacaggaagtctttaaaaataattgttgtggttagtaagtacttatgctaaaatcctgaaatcaaaaatggcttaaaatacaaggaagaaaaaaaacatttcgaatgccaacagtataagaccaaggaacaagtgaatttgttaatataactatttttaaataatctttggttctaaaatataccaaattcctaacaaaaacaattctcctacttcaaactaatggcccttattgaagaaagaagtgtgttacaaatatcaattaaatctaataaacataacatttcattttgggaaaaaagaattttctgggaaataagatttaagtggaaataaattttaacacaaatgttaaatttgaacataccattatgaggctaaataataaataattttctctttttaaaaaataattacctcttgaataaccaaagtaatatgctattctaaaatgtgtccatttcaattgcattcataaaatatttatactaagagaagatagctcttatttgtaagtctataagttcattaaaagaaaaatacagacaccactaagctcattcatgacaacttaattccgtgctttgtgtttactcagggaaataagtgatcatttggttagcagtatgagcacgtgatttatagtaacatcttcccaaatgtaaaattagtaatgttactaactcattggacaattttagacaagacttttagtccatttctgtgctatatgtatatataatataagtactatttttgcaaactattcatatgaaacatgaagctttactgtgtagctgagaatccaattcagtagtccaaagaaactgaccctgatcaataggtagaaagacctgaactcagattttgaagtttttcatggctattgctttcactgtattgactgttagactgtttcatataatacataaaacagaaagtcaagtcatttactaatttctgggcttaaattcagaatcttaaaaaatctaagtataaaatgttaataaaactttatagatttctctaaaaatatctactattgttctataaattatatgttgtaactatttaaaactgaatcatactccatgctcataagactgactatatcgctctacctaaaatgtaaggaaaccagctcatttaaaacccagaaatcaaaacatatcgtgtacctaataattatatacaccttctatcacccacaaaaattaaaaaataaaaaaattagaaaaaaacagaaatattaatttaaaaaattaagggtaatagttgtgataaagtacatcttctaatacgattctactaatgatagtaaatgaaataatattgcatctacacagcagcactacaatgaaacatcaatccaaacttcttctttttatttttatttttcattttttttttgagatggagtctcgctctgttgccaggctggagtgcagtggcacgctctcagctcactgcaacctccgcctcttggattcaagcgattctcctgcctcagtctcctgaggagctgggactacaggcacacaccaccacgcccagctaatttttgtatttttagtagagacagggtttcaccatgttggccaagatggtctcgatctcttgatctcatgatccgcccgcctcggccccccaaagcactgggattataggcatgagccaccatgcccggctcaaacttctaaatagctctcaaaccagcagaaaattaaaacagtttttgacttatgcaaaaccaaaagtttctcagatactggcacgttcagatttcagcatttccaggtttctatcacattcaaatgtataggtgtcatccatctacttcatagtagcctggaatcttttagttctgttctgtatttcacaattgatagtacacataatttaataaattaccaggagaacatgaccatattcatcttctacacacctacttttttcgacatcaaagagaatggaaagattatcaaaagatcttttccttttactgttattaaaacagtaataaatgaccatgattctcatggaattttaaccatctaaattgaagtacaagaatcctatggtgcataataccttttgaagatgattttatttataataaacagaaagaataagggggccatttatacataggataacatattctgggacagtctctaaggtcacccttgccataagttgacatgtggctataactgtattttattctaagtattcacattttccttataaatatagacaaatgattttacagtaaaaatgagaaaaagtacatatagcatacataatatattacggtactagacagactttaaaataaacattagtcagaaaaaatgaatattatgtgtttttcaaatacaatttttctaaagatctaaatctattacaaatgcatatattttaaaagcaataaaactttgaaaattttgtaataagaagaacagtgcaatcaaacaagagccccataatcatttcattcactatttttcagctgtcttcttaaactccttttttaaattcaatagactcctgttggataatttcataattccctatggattacaaaaccagaagttgtctataaaggtctctgaataattttataattcattatagtaggaatagaaattacctgtacattgccaaagccaaaatcaagttgatgtctacatgagatcagcaatattatcaaatgaaataattggtggttatctaagtgatatataacaagggttttgagaaaatactcaatttgctcatcaatgtctaaaattccaccaatgcagattagttattttttcttaagactattttatttttaatttatttttatttttgtttttattttttgagatggagtcttactctgtcacccaggctggagtgcagtggcacgatctcagctcactgcaaccttattctcccgggttcaagtgattctcctgcctcaacctcctgagtagctgggattacaggcacccaccaccacagccagctaatttttgtatttgtagtagagatggggttttgccatattggccaggctggtctcgaacacctgacctcaactgatctgcccgactcggcctcccaaagtgctgggattacaggtgtgagccaccgcgcccagccttcagactgtacctacttagtaaagggtaaggtagcattttaagcattggaagtaattcgtgtattatggcagatgattttattggtccttttattaatagcatacattgataggagaagggtgaaaatttgaagatacagaatggagtaaataagactaaagaaaacaaaccacctattgttaatttttagaattttagattagaaattggatacccaataaatagaaaggtattttctgttgggatatgtgtatgagagctaaaacataaaaaaaaaaattaacacaccaatgtattcaagtgtaacagagtatagttaaatgagatggcatacaaaatacttatcacagtgttgagaacttaaaaagggtgataatagcaacggtgatggcagtttctactgttataaccattataagattagcttctacgttcaatgtaaatgcagggaaacaaaatgtttggcttattttgtatttcttgacagtttggtaagtttatcttaatacactaaaatctttaaactttaaaataactgtatctcattttggccagacgtcatgaagaaacaattcatgcctcttctaagcactgtgagtagaagacagagcagaaatatctaggcagtaaggaaaaggattctggatttagattcagtggagctttgctcaattactgattttaccacttttaactatctgatctgagcaagtcttttaacatctctaagctttattttactcacctatattatggtgacattaacacttactctattttcccttcaaagaatattgcaaagcttgaaggataaatgttacaaaatgatttgagtattctggtgagagctgcagtcctttagtattatcattaagattttattcaggtacacaaaattttagaaaagttgtaatgaaaatctcactttttatcttcacagactatactagcttaacaagaagaacctcaggatgcctctctggaccacatttttctcatttgttaagcaatggggtactggatgatgtcacaatttcctcccatctctgaaattattatattacctagtaaaattcactttcctggattttttttaacctgaaaatatgagaagctgttgcaaactaatctctgaattaacagctgaagcacgcattttaaaaacctccagaacatgagattgaacctctacaacatctggtcatgtagagtaggttaagagtactaccatttgtgttttaagttcttcacgtattttctgtgacattttagctccttgccgtagagataagggttttcccactggtatagtgaaagggttagaagtgttcaaagttcagttattttttaatctaaattttcctttatatcctcaggtattatttgatacactattcaagaggcaaaaattaaaatggaatgattataaacaacaacaaaaagcaaaaagtatcttcacattttaataagtaagaacacataaccaggttatattgctgtaaaataaacctcaaaaaacacaaattaagatacctgtctccccttaaaacccttctttccacggatcccaggaatgccctagaatatagaaaagaaaaaggaaatatttgttgaatgaatgaattaggtactatagatctttttctcccaatataaagcaataaagtatgaaaaagacaaaaacaaattgttctataaactgatgtgatattcagaaaagcctcaatatattaatttaactgaggcagcccctttccttcttcaaaacaaaattctgcttttattcaggaatctatcccatctatacttccaaatgggatcttgacatttccctggtgatagctatttgtccagagacaggcatattaccaaagttggcacaactagatgaacacgaaggtcttattttccacatctaagggacaacgccctcctctctgccttcccctctctatctggatataaacaaggacacatttaacctgtgcactggcaatcttgcaatcatataggaaataagccttagggtaaagacaacattagaaaaggtaaagcagagagatgaatctacagcccacctaacctatggatttctggtcatgtaagaagcagtagggtacagtacttaagtacccaggctttggagccagacaaaaccttgtccaaatcctgggtctgctcttacttcctgtatatagtctaagacaaaatacttcctctgtgtgtgcctcattttcttcatctatgatgagaagaataacaatacctatcattcaataaatggttttatttataaagaagttaattcatgtatatatacacacatatatatgtttattaaaatcttcatgtatatatacatatataaataaagaagttaattcatgtatgtaaaaccatttattaaaattttttatatatatgtacatatataaaaccattcagtaaatcatttgctattttcatcatcatcattaaaaatatctttatatttaagccagtttgaattgtggttttctgttacttgcagattaaagcatcttacttgatactatcactttgagatttgcagactaagcagtctgtcacaaccatgtagcttgagattaatagtacatacaggtaagttagaagacatcactggctgaaacaatccattcactttcaagtcaacagtgtttaaaaaatactcatgtatctgatcatcaaaaaagagttcataggtgagcaagaggactcatttcattaagactttatgtatatttacataatacaaacaatcttttttaaaaaaatagaataattatttcctaaattttcagtagcctccctaaatctcatcaagaagccaaataatgcagacagaattatataagcatttttcatatatatacatgtatatatgtgtacatgtttcatatgtgtacatatgtgtatacacacaatatgcatgtaatgtacaatattgactcccagaaatgacttctttccatttgttttcagcaatagttagcattactctatcttattttcttctgcttttttgtacttaaacattttataacgtaacacccttttagctacatcattcacagttttaatgaaaattttgacatagccaaataatattaggacacagtacccgtgaggggcccaatatcacaaactgatcttgtgtatttatatgttaagacaggtcttgattttttttttttttgagatggagtcttgctctgttgcccaggctggagtgcagtggtgcaatctcggctcactgcaagctccacctcccaggctcatgccattctcctgcctcagcctcccaagtagttgggactacaggcgcccaccaccaggcccggctaattttttgtatttttagtagagatggggtttcaccgtgttagccaggatggtcttgatctcctgacctcatgatccacccgcctcggcctcccaaagtgctgggattagaggcgtgagccactgtgcccggccaggtcttgatattttcatatagactgctaaaaattagtgagtgtgattacagcaatgtgcctattgatggccagtgtcaacactgggcttaagatcattaaatccaagatgacaacattttacaaggacatataattttggtttattaaataatttacaagaaataagctcatgtcaaaggatcagaaaaggattgttatcacgaacagcagagtaattaacaacgtaaactggaaccattgggtcaagaagtagcagatcaattctctgcgtgatcggtgagatacatcctccgttagtttgctgtagtacatgaaggttaggtggcttagttgtggaattatgcttaagatgttttttgctattgaacaaaacaacttgctatgttcaccaggggaaaatctttacctcatctcaccaaagatggctagacattttgattgtcattacagcatatttaaactctttgattatttcttctctgcaggggcattcacaagtaattacaagaaaatataatttaactcactcactgaaaactatttatttgaaaaattcatttagcaatgaatctggttcactttcatttgcaaaaatcacttgccagaaatgaaaattttggcctgaactacattcttataatgataggggtgaaggctgaatgactctctaatttcaaattctatgacaatctactaatattgttcaattctactgttttcaattaatactggcaatgtaaatgaaggaatacaaagataaattactgcatacagattgcatatagcactgaaaactagatatgatgaagctgcaatgccataactcccataattaacttcattaatctttttagtataacaaaccattttgcaaaggttctatctttacttataagtacccatatttattaacagctatctcccattattaaattaaacaaaaatatatcttctgaggctaaattctttactgtatattgctctcaaaatcaagacctgtcaagaatttatactcttgacatatacttttgtaattcattataatgaattacaaaataaaaatttcataattagatattttaatattttggtgtattttcaaaaatttgaacttaaagtacaattatatttctatcatgctatattactttcctttaacaaaattcagtaagattttcaaaagtcaaattacatttctggcaggtgatttttcttcaacctggcttgctaactcagtaagattacttccctgacatctgattttatgacccccattgtacattatcacaagtatatcactttagaaatactatttgaagggaatggacttacccgttctccttcaggtcccagttgtcccgcttctccaggagagccaataaaacccttaaaacaagaaaatagtctgtatattagttcatttgaatattctccccataagtgattctgaatagaagtacttaaaattttatttgtagtagtacgaaattacaagacttacaagtgcgaataacttcccctcacctaattgcttttcttccagaagttaaagatcaatcttcccattaaaaattatacaaaatataatttaagaaatggtggctattaaaaataagcccaaataatttccttcactaaattttatagcgggcagaaaatatatgtatatgattagctaaaatttaagacagaatggaggtatcaaaagaatataagaatataagtataagaagtacagtggaggaagagatacatttcaatgtggcaggaggcaaaggcaatcaaagaaggcttcaaaggagattaccacttgagataggtctagagaataggtaaaatcttggtaaatagagacataataggaagtctttgttaatggtaacaattggggagtgtttgtaaatagtaattgatcacattttatacataatatactttgtgtgtaagatggttttatatgttagctttatgtgtaagacccaccctgccttaataaagattccaatctgatctgagaaacaagggatacatataaataacaatgcaaggcactttattctaatgtaacttagttatatctcacttgtgggaaataacccatttcatcaattttacagataaagtgtatggtagtttaggggctagattaaggagagtcttaaatttcagaataaaaattttagactgtatatattagacaaatggaagctactgattttagggagtatggtaatgcactgatgttatgctgtatttctaaaagattaatctgttgataggatacagcatacagccatgacaggaaacactgaatataggccaacctgttagaaggctctttaagtggtctaaatttgaaggtttacgggtccagatcactggttcaacaaacattattttagtagccattttgtgtctataaagatttggggtttataaagatgcatatgaaaatcaatgccctcaaaaagtacatagtttattgggaaagagggtcatacaaataaataactgtaacatcatttgataattgttacatgattatgcaataggtgatatgacaaatagacaatgggaactttggaagcagaatgaccaactttgcctagagagaagattaatggtgctttgctttactgaggaagcaacatttgagctaagtcctgaagaaaagaaaaggcagggctaacaatgtgccatcagtcaatcaatcagaatgaaatgacacagcatttgcaaagaattgcaaatagtctgtgtgattggtgggcaagaggtgagtttggaaagggtggcaaggggtcatgtcatgaagagtcttttttgttatgatggaaagtctgcaatttacactgtgagtcattaaaaaaacttaagacacagttttcatataatcatattttcactttataaattcacttggattacagtgggtcacataggtctctatctgtctataagaatcaagagaaagatgactctaaagtttacagctggactgatagacaaatgttaaccactgatagaaatatggaaaacaaatagaaaacctgagtttgatataaagaggatgagttttgttagttattttgaatttgtgattataatgagatattcaaatgtaattatcatggcagggagttgggagatgtggggttcatagaaaaagctcatagagaaaaaaagtctgaaggacagatatgtctgaagtcttaaagacagactaaagctttgaggagaaaatattaggaaaaattatcactgatcagacagagggtgaaataggggtgtgagagaagagtagttttatggatgcagagaaaagccaaagtttaaaagaaattgaagtagagatacagtaggtcaattttactaagttctaaataaaggtttcttattttgaatcacagaatgggtgatttttcagagtaaatacttccataataacaaatactgaagaattcaagcattaaaaaagtaattgttatttctatacccattccagcattattcacaattatcaaaagatagaagcaacgtaaatgttcattaacagatgaatgaataaacaaaatgttgtatatacatgaaatggaatattattcagccttaaaaaagaaggatgctgataactgccacaacatagatggaccttaaagacaattacgctaagtgcagtaagccagtcacaaaaggacagatagtgtatgattccacttgcatgatgtacttatagtagtcaaattcatacagacagaaagtagaatggtggttgccagggactgggagtggagaacggggaattgtttattgggtacagagtttcagtttgggaagatgaaaaaagtttttaagatggatggtggcaatggttgtacaacaattggatgtacttaaggccactgaccacatactttaagagggtttatacatggaaaaaattttatgttatatatattttatgttctttattttaaaaagaaagagataaatgtctcaagaatcatatctaagttgcctggaataaaacttttggaaggttttatttccttagaatttagttaagtattgccattaaaaaagttgccaccatccatcttgaaaacttttttaggtgtttttccttgtcaaaggtgcctgaaattgccttatgttccacagattgtatgaacaagcaaaaattaaaagaaaagagggagagagagaatttgttcctttatacataactttaataaagtgaaacatctatgattttcttacttgaaagccaagcagttggagaatgggaaatgtttcttttaaagtgaatcatacaaaagtatttctgatactagagcatttaggattatgatgacaagctgtgtacattttcagaatcatctgttgatgacttcaagtgtaaagtcagctaacatttgttttaatatatacaacaggagttttggttataaataaaaagaaaagacactctaactggtatatacttatcagtgaactaaataatcaattgataactcaagaactgaagtcagaactccaacatagcctgtacagagtgtaaagggaacattttacaattagatattttaaatagaataatgttataagtaattgcttaggtgtttcatagaggtttcttgatcatcattacactgattctaacagaaataagatgtcagcagtaccaaagaaaccacagagttgaggtcattctcaaaataccaccatgaaactagagtttaccgtgtaatgaaacaaagaacattaaaaataataacacatgtttttgctttttggtttgaaggttgtagatccagttagaagcaattttgtgtcaccagcaggaccaccagaaggtcgggagaggttctatatacttttacttttgggggcagctagcacattattacataaggaaatgccaaagaagggtttaaaaattatgatgtgttttaaacatttacatttgacaaaatatttctgctaataccaaaaaataccaacaaataactgccaatgaaaagctaatttatcatgattcatgaaaatattcatgtacaatgcataacatttagaatttaccagtaacaggacacaaattaagtgaaaaacatgtatcctatgagtgtgtttctatgatttttgcctttttaactagattttaagttaatgctaaaaatctatacttgataaagctgcaccctactacccactgatcttcgacaaagtcggcaaaaataaataattgggaaagaataccctgttcaataaatggtgctggaaaacttgctaaccatatgcagaagaatgaaattggactcctacctctgactgagttaatatataaaaattaactcaagatgaattaaagacttagtatgtaagacctcaaactataatcctagaagaaaacctaggaaatacccttctggacaccggcctaggcaaagaatttgtgactaaatcttcaaaagcaacaaatgtaacaaaaaatttggcaattgtaacctaattaaactaaaggtcttctgcagagtaaaagaaaccatcaacagagtaaatagacaacttacagaacaggagaaaatatcttcaaactatgcatctgacaaaggactaatatccagaatctacaaggaacttaaacaaatcaataagaaaaaaacaaataactttattaaaaagtggacaaaggacatgaatagacacttctcaaaagaagacatataagcggccccaaaacatgaaaaaatgctcaacgtaactaatcagagagattcaaatcaaaaccacaaggggataccatctcacaccagtcagaagagctattattaaaaagtcagaaaataacagatgttgatgaggtttcaggaaaaagggaacacttatacactgctggtggtaatgcaaattagttcagcccctgtggaaagaagtttggaaatttctcaaagaactaaaaatagaattaccatttgacccagcaatctcattactgggtgtatacccaaagaaaaataaataattctaccaaaaacacatctgcactcatatgtttattgcagtactattcaccatagaaaagacatggaatcaacccaagtgctcatcaacagtggactgcatgaagaaaatgtggtacatatagaccatggaatactacagtgccataaaaatgaacaaaatcctatcctttgcagcaacatggatgcagatggaggccattatcctaagcaaattaacacagaaacagacaacaaaatactgcatgttctcacttataaatgggagctgaacattgggtatacatggacacaaagacaggaaaaataaacactatagattccctaaggagggagggccagaaaaaggcaagggttgaaaaactacctattgggtactatgttcactgctttgacaacaggatcactaaaagcccaaacctcagcattacacaatatacccatgtaacaaagctgcacatatacccctaaatttcaaataatttttaaatctacatttgagaccctttatgaatgtgaaattccctccttattccaatcacactcccaagtgtgaaacctaactaaagtgtgaaaacttaactaaaagtacaacttaagagggttacagcctagaaaacaattttcaatacaaatgggaaaaggaaaaaacaaaaggatgtataatacaatgcaaaaatggtacatggaagaacacagttatatggatcactgaagcaagatgacaaaacgcagtaagagtaagttgtacagtgccaaatatattttgcatatattccttggagttactagttattgaacagaagacactctcaaattcaaataataattatagaatctatatagtaaatacatgcatacactatgccctataccttaagaatgctcatcttgtttaatttttcacaactacctgaaaagtaagtttcatcatgaccatttaataaataatgagataagaaaaatgaagcacagagagactgaataacatcaaaagtcacaaagctagtaaaagaagtattaaggggctgagcacggtggctcacacctgtaatcccagcactttgggaggctgaggcaggcagatcacaaggtcaggagttcgagaccagcctggccaatatgaatccccatctctactaaaaatacaaaaattagctgggtgtggtggcaggcgcctgtagtcccagctactcaggaggttgaggcaggagaatcacttgaacctgggaggtggaggttgcagtgagccgagatcacaccactgtactccagcctgggccatagagtgagactctgtttcaaaaaaaaaaaaaaagcctatctaactccacagcccatgttcttgaccactaatctcttctggcttcccaaatccaagtcaacatgtgttttcagtgcaatttctaataaaaagtacatgacttttcctcattatgtgattacttaatgcaagaacaaagacagcatgagctcatgaaaagaggtcagggctaaaggtgaaaagacattggttctagttctagccagctataactttgccagatcaagtaagttccttagcttactatttttctcatcagtaaaatggggatgacaggcctgttctcctacatcacagggctgatggcaaaataaaagaataaaatacatatgaaagtatttggaaatgtttaatacttttttaaaatgtaagacatcattattgcacatattgtttaaataccttatgctttacttctttttaaaaggcatgttaggccgggcctggtggctcactcctgtaatcccagcactttgagaggctgaggcaggcagatcacaaggtcaggggtttgagagcagcctggccaacatggtgaaaccctgtctctactaaaaatacaaaaattagcctggtgtggtggcacgtgcctgtagtcccagctacttggaaggctgaggcaggagaatcgcttggacccgggaggcagaggttgcagtgagcctagactgtgccattgcactccagcctgggcaacagagtaagactctgtctcaccaaaaaaaaaaaacacaaaacaaaaacaacaacaacaaaaaatattgcattttagataatataaggcacaaatgtagactttgaaaaatatttggctattaaaaataaagaattttaaaaacatattttttattttatacactacatatatgatatggtttggatgtttgtcccctccaaatcgcatgttaaaatatgattcctaatgttggaggtgtggcctggtgggaagtgactggattggggggcggatccctcgtggatggtttagcatcatctccttggtgacaagtgagttctcaactcacatgagatctggttgtttgaaagtgtctgggaccttccgtttttctctcttactcccactctcgccttgtgacattgtctgctctcccttcaccttccgctgtgactataagtttcctaaggccctcacaagatgcaaatgctggagccatatctgcatggactgcacaactatgagccaattaaacttctgctctttataaattacccagcctcaggtatttatagtgatgcaaaaagtgactaatacaatataatatagaaatgtttattttgcttccttagtgaataaaaatggctaacatttcctttaatggtttgggagtgaaatgggatgttctggatacaataaggttatttctttctttgtagatatttctttactcctgacagtttttgtataataaaatgatctcagccttgaactactatgaatttctttacctcttcatattttttccatgatgacttccttaggtctgtatccattcatatataaataacactacaaatgtttacagagcacattctaacatgccagacattatgctatggaaataaatataaaataatgatgcaaaacctaccacaatgagactgttttctgtcatcatagaagtgaaagcaactgcagtaagcaagtatattcaggctacatttgaattaaattcaaagctactaagagagtgtaaaaatgctaagtgttttatatatttcattctacttttaggcaagcatgcttaacagaatgatggaaatgcctacttacttgtgcacctttaggacctggattaccttctggtccagctaaaccctggtgtaaacaaaagacattgtcatcatactacagtactttttaaagagttaataaatagattaataaaaaggccatataaagagctatcattttcaaaactatagaattcagaactctgtataactaatgaagattaccaatgttcaaggaattttagaatttctgaatcaaaagaggcactggaaataatctatacacaatatattttagatatataaataaagtacattaacacattgtcagatttttaaaatttttttcattacattatttctcattggaagactgtgttgttttaaaacatttctaattaacttattctaaaagataggcccataaattttttttaaaatttattttaaactttagatcaatgtccatatatttacatattcatgttttatatttattatataacatatattatcacttgagagtaagagtctaatatagagtacctctaagtgtttttaaagtcctaaaaaatggaattttgttaacaatttttttcttatttccctcattcttgagaataaaaaagataaatgtaactttatacatttaattaattttagaagtaatcaattcatgaaaacttatgaaagaaagcttgttctattattaatctacatgaagtacagaaagttagaaattataagggaatacatttaaaatgattagaatgcattttaaaaatagtatacaaataactgaattcagttcagataaaagtgtttggtagtggtatactgtttctcaaatttttataactgtgttattaaaaaatgatgtttattacagagagtcttaactcttactattacttcattttgttcagtgacagtattgtaaaatcacaatcaggactgttttaagaacttattaacacttgtgcattttaattttgaaggttccattgtacatcacatcaaacatatttaaaatcccccttccaattttaaataaaactttctgaagaaaaattgtaatggatttctacaactttgattttgaaattatttctctatgagttattcattatttaataaaaaaactatttgaacattaattctcaaaatcagaaatacaatgtattaataaataggaacacaaagagaaaagtctaaatatagttactgcacctgcctgccagggtaaccgggtgaaccaatattaccagcaaatcctggaattccctgaaataataaataaaatgaacagtatagcaaagccaaaggaaacaaatttggtatatttacaatacacaagcttggaaataatttttccccataaaaatacggagtcctacacatggcttatgtaactgaaatcacctacgtgaaggaaaatggacaaaaattgctaaataaaatcagtaaactattagattagggccctaaatgatatatgatcattaataatcataaatctaggatggaaaaatccatactaaaacagacatttattctagaggaagagctggtatatttcttaattaccagtaacttttttaccagtagattgaattctttcttgtttcgatcatcctacaacactccttaacagtctgagcatgagccccagaagactaagaggggcagtaaaccacaaaaccaacctctacttctttcctaaagtaaacttaaccttacagtgagtctgattaagtaaatgaatattaagtggcaaataccgttatcatgacatgggtctgatccagtaaatttgaatggtgctgtggactgaatgtttgtgtgcctcaaaattcatgttaaaatcctaaccctgctgataatgcctaacagcattaggaggtggctctttggaaggtaattaggttggagccctcatgaatgggataaatgaccttataaagaggccatgtgagaatacaataaaaagtcagcagtctgtaatccaaaagatagcccccaccagaacctaaccgggctggcatgctgatctcagactttcagcctccagaattgcgagaaatttctgttgtttataagccacccagtctatggtcttttgttatagcagcccaaactgacttagacagatggtaaactcctttggaatttgcaatctgtattcttgatttaaaacaaggtttgctcagggaaggctgatagatggagacccaaaggcttaagaaaggaaaactgctacagaactgggtgaaaaagtgagacaaaatattataactttttttttaaaaaagactctttttcattgatacatcattcattccttcatttactcatcagtttattcagagtttgggtctattaaataattcttgacacaaggaaatgtcagaagaaagtgtgttgagctgatgacaacaatgtttaagttggctagatttcttatttatcacctaaaatttctttcctgtttgtttataaatgatataatggaagataattgcactttgtccttctgctctgaagtagatagaagagtgttaccttcactttaagtacagatatgctaaaacttctaaaaatttggaaaatctagagaaagaacagaccaaggaaatgaaaaatagaggataatagttgagtttcttctctctacttttttcagaattcatctctcacttttttccctctcatttctatctctcatttcctcttcccttcccttgatcaaaattaacatttactgagcactttttatttgctaagcgttttacatctatgagatacacttttcttcattctacatttaaagaacctaagatacacagaagtatgacaatggacaactgaagagaatgtgaataaacaatggccttctgaggattacagaagaaattcttgtctatatgtagagagattatatcctatgaatttcagaaaccatatgtatgtattaaatgttcccctattgatattaaatattatatatttacataatattttattcctataacatttattgagcacttatcatgggccaggcactatttcaagtattttatagatattatcttattcaatctactcaaaaaccctataagatagatatctttattcccatatgagagatgagaaaaaatgagacataaggtgtttatgtcaccaatgggaggatacttagctaataagtaggaagtcaggaattaaatcagcaagtctaattccagagaccaccattcaaaggcccgtctccctagtgtgagtttgaagtgcaaaaaacatccaatagcactccaaggaaagtcctctaattatgagatttgctctagtatatttacaaccaccttcctatatgccccatccaattccaaaacacataggcccacattctagagattcacaaaaccttatatttaggtatgccaacagaaaggagtaagacaaatgtaaaaggctgtttttattctgtaggccactatctatctggctaatgaaaaccaccatcccttttccattcctttcctagtcaaattaagttaactaacctcgataaaaagtcaatctgttatagaacataagtgaaatcctatttcgaatggattgtcacagagggtgttaaagcaacatgtagagatctagctaacacattttagctatgcagagaaagacacaaaagaattccactcaatgtctaagttctgctatactagaacagcagtaaacaaaataaacaagtaagacttcagcataatctttatatggcataaacgtattctgagccaaccacaccctagaatcactgagacaaccacagaaactcaaaagaaactcaaaacaaatatcatgacttaattcactctgcatttaaagatagatttttttaaaaagttggctcactcagatctgcagattggatggagtaatagagatacagttatatcaacagccccttgagaaaacaggaacagaaaattaggaagcctgccctaatctcacttaaaatacacattctgagtcagttagacttcattcagaattccggcactgctccagcactgctactatagtttctctgttttttcattagtaaaatagaataacagcactcattttgtggataaaatagaacaatgcgtagaaatatatttaaaagtggaagtaactgtaataactcttagtattggtgacattaagttaattaacatatgtaaaactgaataattatactactagaagttgtagttaatagtaatatagtttggcaaataataagggctgtaagtaaatgacagctcttattactagagctcacataaataatataattgcctttccaaatgtttgctgaacaatttgaagatatttacaaattttcaagacaaatgtcttccagcaagtcagctatgctcctctgaatgtccacagtattttcacaattaaaatgcaaaattattttagctgtttctcatagttaacacaaattttgcctgttttttttttctggaaacaaatagaatagaaaggaagaactgactacaatatacattttctaacctttaaaattggttttagactgttctaaaaagtatattaccctcagagataatatatacaccaccagtactagtttatggagcagttttgagtgaactcgtcagtaatgacacatggccaatttttcacttgtgaagtatcaggtttcctccattggaatccacgtttctgccaaagcagtaacctacaatttttttctccccagggactaatcccactcacccttctcatctttttctcccataaatgctcaaatgcttttcagtacatgtttgatttgcaggaaactgatattacatgtgttagagatacatatatcacttcgcttgccatgtctagtaattagcaatcttgaaaagttgtgcttcagggactgaacagagtgtactgtctaacttaacatgaatgaaagggaaaattggctttgtttcttcatttatagctttccctcaggtaccaaccatcacatttcttcctggatctccctttagggtttcctgagtctctgtgctgattctttaataacggtatccatcaccttagtcagtttctaatatcttacccttttcactgttatattcatattatattttcaatatagtacacaccataagacatatgactttatttttttctgtgacataatgatatattattttctgatgagagaaaagcaataacatgatcaaaaactaaatagttccaaaactattttgacttttaaatattgtgtatgtgtattatggacaatgatatatgtaccattctaatttggactgttattgaaatttatttgcatttcctcaggaaaaggtcagggaacaaacagctatggattaggctttagtgaactggtaagttcctgacattgtacaaaaaaaattaagtctctctctctgtgtgtgtgtgtgtgtgtgtgtttgtatgtgtatggatatgtatattttctgggaaaggattcatagtatttatgagactctcaaaggggtctgtgaactacagaagtttaagagctactagtctgaaacatatggggcaaaagtaaaaaatgattaacagtgaaatattatgttatagttttttaaataaaaagatctacagctaatcaattaaaaggttgtcctgcactaaacagagtaaaaaatcactgagaagaaaaattgaaaaaatgggggaaaataatctctcaaaggagttctctaacatgtgtctttttcacacatgatacaagtcttataaaggaagtacctacttgttcacctggaagtcctgggagtccaggatgtcctttgagaccctgtaaaagaataagtggagacatgctatgaaaagtaaactcatataagccaaataacgaaacataggttgcaagttgccttatatcccaacttttggttgcctcatcaatacaaatttaattgttactaatttatttcttattaaatttaatcttctttatttaataagaattacttttttattaaataaaaaattaattcttattaataatttaatcttgcatgttattttaatgacttgttattatcaactaaaatggtagcatagtactgaatagagactaaagcacagtatcttttataaaaggctcatatctagcaatggatatgttaagtttgctgaagcttttaaaaagttagttttagttgaatagtgctaagacaaatggcctcagacataatctgtttgtaattattgaaaaactggatcatatccaggcagttcctctaacccaaatcattgtcataacaccccatgaatgaggtaactcaaaaaatcatgaggctgcttacaggttcatcaaaaggggttctataaagttgtctagggaattagtaacaaagaatattttccaaataatagaagcaaaagaaaatcttaatctctataaattaacacccaaagctataaaacagacaatatccttcttcctcaagaaagatataggagcaaaatgaaggaaactaaaagaaaggatggcaagaatgaaataaagaaaaattttggagcttatttgtacagttctacataaaaatcagtggtttgatctactgtttaccaaaggattttggtgcatataaagaacaaaagaaattccttttcttaaggacttaaaatataattcaaaagcctgaaataaatcatagtttatgaatatcaaaaatttccaattaatatactgcaaactaaagacaaatttcctgggtttcagaatatagcctaatggagtgaaagaattactcagtattaatcactgagggtttatcagaagagatgaattcggattaatggattagagaagggaatgacgctttggttgaaaaacgtcatttagaagaggtgcctatttgaaaactaaaggaatgatttcaacagcttttgcgatgttaaacttaaaacagtttaactgtttttacatttttaaagggagttcaagattagcctaattacataacatattacatattgtgctcagttgcccaaatgtttacacaaaattccacaagtaaaaatatccacaaagctaagttttttcactttttacaacaggagataagaaacatcctcagcgctaagacagtggtggtggctccctgggatgaggcagcagctctaggagggtgtgagctggaagtttcctggaggatgacaaataaagagccagggtaggaggctcataggttacagagactctgccatgagcctatttccttttcctatttttttaaagtgtgtgtttatttatttacttattttaaattctgtgaatccttgagcctagctacatgcttgattttctttggccaacacctgtttttcagatcagagttagtttcctccctagcctataatgaaacaaaatgcaatcgtggcacaattttattttagcttattttccccaaatcactccataatagtgaactatgtgtatatatgttaatcatggtatcttttttatgcacacttctctttaaagggattcttcttcattcagagaccctgacaaggtggcagcaccatgcagtcatgatctgttttttatgaacttactccttccccacctcagccccaggacttgacagttaatctaagggaggacaatataagtcaggccagtagcctataaaatgacttggaataaagagttttatttaaataaaaacaagctgggccaggcaaatggcattcctgtagtccagctactcaagatgctgaggtgggagggttgcttgagcccaggagctaaagtccagtctgagcaatatagcaacctctaaaaaaaaaaaaaaaaaagagagagacaagctgggccaataaaaatctcttttttaaaaaaatgaagttgattaaaacaacaacaatagaaaaatgcaagtacttaacagtgggggtaggagggagctggaaagattcacaaagaaagactaagaggaagagtagggtcgctgagatgctacaggaagccaaagtatacacaaaaattaaaattgaaattatgttaagacagttgtcagaggacaagataacacaaaaaagcagatgcagagaaagtagataagcactggtagaaaagtacaacaaaagattcacaaactaatgctgctaagataagctgctttgaatcagtgtgtatgtcagaccaagtcatattacagtacctagttttagattccatgggatccctgtttccttattgctgcagacaggattgaaataactcactcttttccttgaaatatcctaagtctcctttttttttttttttttttttttttgaggcagagtctcgctctatccctcaggctggagtgcagtggcacgatctcggctcactgcaagctccgcctcccgggttcgcgccattctcctgcctcagcctccggagtagctgggacttcaggcgcccgccaccatgcccggctattttttttttcctgtatttttagtagagatggggtttcactgtgttagccaggacggtctcgatctcctgacctcgtgatctgcccgcctcggcctcccaaagtgctgggattacaggcgtgagccactgcgccctgctaaaatatcctaagtcccctttctacgcaatccgaagagcctaagtaaagcaatttttgtttgtttgctttactgataataacaatgaacagatcaagccatcttgatctgttctagatccagttttaccacaaactagccatattgtgaacctcaatgtcttattttgtaaaatgacagcattcaattaaattattgctaattttttattgcttaaatcctgtgaatactggaatctatcagaaagtaactacttttttcaatgtagctgtcactgaataaaaaacaaagcagatatgagttacttcaggaaggccgggcgcaatggctcacgcctgtaatcccagcactttgggaggcagaggcaggtggatcatctgaggtcagtagttccagaccagcctggccaacatgatgaaacccgtctctattaaaaatacaaaaaaattagccaggtgtggtggcgttttcctgtaatcccagctacttgggaggctgagacaggagaattgcttgaacccaggaggcagaggttgcagtgagccgagattgcgccactgcactctagcctgggtgacagagcaagactccatctcaaaaaagaagaaaaaaaaaaaaagagttacttcaggcttggagacataggaaggaagaattcacgtaaggtcagtggacatatcaggctcccacggggcacttctttaatgctctaaaacaaagatgggactctggagtgggcaaaatggaagagagtgggttgggtaggaggctagtatgacagtctaggtcaaagataattataagttagcctaggatagtagagtaaaaatgatacctaagcccttgaaaaagcttaagcttaatttaagttactgtactcactgtggtgtccccagtgcctggtacatagttgttgcttattaattaactggtggacagacatggatggatgaatgaatgaatggatgagtgaatgaaaagacttggatgaatttaagaatcacttaggtagaaaatagattctatgtatttaatatggtaactctattatccgaatgttgaaatgaaaggtgataaatagaataaagacttcctttttgttattttaaaatatatatttgtaatatactgaagttatctccactattatataaagactttcatttattcccatatgcctcatttattttctacttaaaaactagtctgtaaagtttttaaaagcaaaggggatacattccttggaaaactgcctacatgcaagctttggcatagctccaatctagggattttattttaaaaactagtatttgagtcattattttctatactcatacaggaagaataacaaaaaagtttccataactagcatatgatttttctctgattagcattctgaaaactgaatacattccttaaggaatgacaataggaaaatttacaaattgtttcaattcagatttaaaacacattacaatgaattacagaattgtctttaatttttgttgtaatataaaatcagtttacaaaggagggcagagcaagatggcaaaatagaagcttacgctattcgtcccctctccaacactggaacatcaaattttaacaactatccacacacagaaaaccacagtcacaagaagcaaaaatcaggtgagcaagagcaatcacagtacctggttttaacttcatattgtggaaagaggcactgaggaggacaagagatacagtcttaaatagtgaatgccacccctcccccatctcccctggcagcagccctgcagtgtggagagagaatctgtgcactctaggaagggaaagcccagtgactgggaaactttacattgaactcagtgcttccctggcacagcgggaggatttggaccagccctagccagaagggaatcgcacatcctcaaggaacttgagtttcttggcaagccttaccaccatgggctgaagtactctggggtcctaggtaaacttcaaaggctgtctaggacacgacaactgcaaatcctaggctattcctagtgctaggctgggcttacagccagtgaactagggtggaatgtgaactaaggagacaacagctggcatggctaatggagtgtgagcaccattccttccctaagcccaggcagtgcagctcataacaaggaaagtgactcttcccttctgcataaggagagaagagtgaagagtaaagaggactttgtttggcatcttggataccagctcagccacagtgtaatagagcaccaagcagagacgtgaggcccccatttgaggccctagctctgggataacatttctagatgcactctgggtcaaaagggaacttcctgctttgaagggaagggtctagtactggcaggattcatcacctgttgaccaaagagcccttgggccctgaataaccaccaatgatacccagtgagtgtgctgtgggccttgggctctgaaacatgctggccttcaggggtggtccagtacattccagctgtggtggtcacagtgaaagactccttttgtttgagaaaagcaaagggaaaaagagacgggattttgtcttgcaccctatgtaccagcttggccacagtagggtagggcaattagcaggctcttggggtccttgagaccaggactaggatcttacacagcatttctggaccgtccctactgtgctgaaggatgagtcacagtcctggcagcattcaacacaagctgatggaagagagcccttggcctttaagtaaacattggtgaaagcctagcagaaacccccatggactagtggtggtggccacagggaaggactcatctgcctggggaaattgctggaaagagtaggaaggactctgtattatggtttgaatgggagtttagccatagtagagtagaacagcaggtaagttgctaatgtctttgacttcaatcactggctcccacacagcatccttggacacaccctgggcctggggaaaactcatcactatgaagggaagggctttgggtgaggcccagtagctcatgtctgacccagcacagttccagtggtgacggccacagggtgcctgtatctccacacccacagttccagctggcccagcaaagagagagagagagaggagagactccatttgtttagaagaaattaagagaaaagaacaagaatctctgcttggtaatccagagaattctttcagattttatgtaagaccaccaaggcagtacctctacaaaaaccacagcgatattgggcttggggcccaagtcccttcaaacacttggaaagccttcccaagaaggacaggcacaaacaagcccagactatgaagactacaacaaatacctaactcttcaatgcccaaacaccaatgaacatctacaagtaacaacaccaccacaaaaacatgatctcaccaaatgaactaaataaggcacggggccaattcttgagaaacagagaaatatgacctttcaaacagagaattcaaaatagctgttttgaggaaacccaaagaaattcaagataacacaaagaaggaattcagaatgctgtcagaaaaatttaacaaagagatagaaataattaaaaagactcaagcagaaattccacagttgaaaaatacaactgaatgctgaagaatgtatcagagtcctttaaaagcagaattgatcaagcaaatgaaagacttagtgagcttgaagacaggctatttgacaaaacacagtcagaggagacaaaagaaaacagaataaaaaacaatgaagcacacctacaagatggaaaacagcctcaaaagggaaaatctgagagttattggccttaaagaggaagtagagaaagagataggggtagaaagtttattgaaagggataatatcagagaactccccaaacctagagaaagatatcaagattcaagtacaagaaggttatagatcaccaagcagatttaacctaaaaagactacctcaaggtatttaataatcaaaccctcaaatgtcaaagattaaaacatgatcctaaaagcagtgaaagaaaagaaacaaataacatactatggagcggaaatacatctggcagcagacttcacagtggaaaccatacaggccaggagagagtggcatgacatatttaaagtgctgaaggaaaaaaacttttaccctagaatggtatatccagcaaaaataggctttaagcatgaaggagaaatagactttcctagacaaacaaaagttaatggattccatcaacaccagacctgtcctacaaaaaatgctaaagggagtcattcaatcagaaaaaaaaaagaatgttactgagcaagaagaaaccatctgaaggtacaaaactcactggaaatagtaggtacacagaaaaacacaggctaatatagcactgtaatggtggtgtgtaaacttctcttgaattaagtggaaagattaaatgaaaaaccaataaaaaataataactacaactttacaagacatagacagtataaaaagacaaagaaaaacaacaaaaagtttaaaaatggggaaatgaagttaaggcatagagtttttatcagttttctttttacatgttttttggtttatgcaatcagcattaagctgtcatcagtttaaaataatgggatataagatagtatttgcaagcctcatggtaacctcaaaccaaaaaaacatacaacagatacataacaaataaaaagcaagaaatcaaagcatactactagataaaaatcaccttcactaaatgaaaaactggaatggaggaaagaaggaagagaagaccacaaaacaaccagaaaacaaataacaaaatggcaggaataagtctctatttatcaataataacattgaatgtaaatggactaacctctccaatcaaaagacatagagtggctgaatgaatgaaaaaacaagttccaatgatctttgcctataagaaacacacttcacctatatacacatagactgaaaataaagggataaaaaaagatattccatgccaatggaaacgaaaaaagagcaagaatagctatacttatatcagacaaaacagatttccaaacaaaaactataagatgagacaaaggtcattatattataacaaaggggtcaattcagtgagaggatacaatgattgtaaatatatatgcactaaagcacccagataaataaagaaaacattactggagctaaagagagagatagaccctactacaataattgctggagacttcaatacctccactttcagcaagactgggactggttagtcagtgggtgcagcccatggagggcaagcagaagcagggtggggtgttgcctcacccaggaagagcaaagggtcagggaactccctcccctagccaagggaagccatgagggactatgccttgtgggacagagctatccagccaagatactatgcttttcccacggtctgtgaaacctgcagaccaggagattccctcggacgcctacaccaccaagggcctgggtttcaagcacaaaactgggcggccatttggggagacaacgagctagctgcaggaatttttttcataccccagtggcacctggaacgccagtgagacagaactgttcactcccctggaaaggaggctgaagccagggagccaagtggtctagttcagtggattccacccccacagagcccatgaagctaaaatccactggcttgaaattcttgctgccagcacagcagtctgatatcgacctgggatgcttgagcttggtggggagaggggtgtccaccattactgaggcttgagtaggtggttttcccctcacagtgtaaacaaagctgccaggatgttaaaactgggtgaaagctgctattgccagactgcctctttagattcctcctctctgcgcagggcatctctgaaagaaaggcagcagccccagtcagggacttatagataaaactccctgggtcagagcacctgggggaaggggtggctgtgggtgcagcttcagcagacttaaacattcctgcctcctggctcagaagagagcaacggatctcccagcacagcactcgagctctactaagggatagactgcctcctcaagtgggtccctgacccccgtgcctcgtgattgggagacacctcccagcaggggtcgacagacacctcatacaggatagctccagctggcatctagtgggtgcccctctgggacaaagcttccagaggaaggagcaggcagcaatctttgctgttctgcagccttcactggtgatacccaggcaaacagggtctggagtggacctccagcaaacccgcagcagagggatctgactgttagaaggaaaactaacaaacagaaagaaatagcatcaaaaccaacaaaaaggatgtccacacaaaaactccatctgaaggtcaccaacatcaaagaccaaaggtagataaatccacaaagatcaggaaaaaccagtgcaaaagggcagaaaattccgaaaaccagaacgcctcttctccagaggatcacaactcctcgccagcaagtgaacaaaactggatggagaatgagtttgacaaactgacagaaggaggcttcagaaggtgggtaataacaaactcctccaagctaaaggagcatgttctaacctaatgcaaggaagctaagaaccttgaaaaaaggttagaggaattgctaactggattaaccagtttagagaagaacataaatgacctgatggagctgaaaaacacagcacaagaacttggtgaagcatagacagtatcaagaatcaaaccaatcaagcaaaagaggatatcagagattgaagatcagtttaatgaaataaagcgtgaagacaagattagagaaaaaagaatgaaaaggaatgaacaaagcctccaagaaatatgggactatgtgaaaagaccaaacctacgtttgattggtgtacctaaaagtgacagggaagatgcaaccaagttggaaaacacttttcaggacattatgcagaacttccccaacctagcaagacagaccaacattcaaattcaggaaatacagagaacaccacaatgatactccttgagaagagcaaccccaaggcacataattgtcagattcaccaaggttgaaataaaggaaaaaatgctaaggacagccagagagaaaggtcaggttactcacaaagggaaccccatcagactaacagcagatctctcagtggaaaccctacaagacagaagagagtgggggctaatattcagcatgcttaaagaaaagaattttcaacccagaatttcatatccaatcaaactaagcttcataaatgaaggataaataaaatcctttatagacaagcaaatggtgagagattttgtcaccaccaggcctgccttacaaggagggagcattaaatatggaaaggaaaaatcagtaccagccactgcaaaaacataccaaattgtaaagaccattgacaccataaagaaactgcatcaattaatgggcaaaataaccagctagcatcataatgacaggatcaaattcacacataacaatattaaccttaaatgtaaatgggctaaatgccccaattaaaagacacagactggcaaattggataaagagtcaagacccatcggtgtgctgtattcaggagacaaatctcatgtgcaaagacacacataggctcaaaataaagggatagaggaatatttacctagcaaatgaaatcaaaaaaggaagggttgcaatcctagtctctggtaaaacagactaaaccaacaaagatcaaaaaagacaaagaagggcattgcataatggtaaagggatcaatgcaaaaaaagagctaacacttctaaatatacatgcacccaatacaggagtacccggattcataaagcaagttcttagagatctacaaagagacttagactcccacaccgtaatagtgggagactttaacaccccactgtcaatattagacagatcaatgagacagaaaattaataaggatatttaggacttgaactcagctctggaccaagcagacataatagacatctacagaactctgcaccccaaatcaacagaatctacattcttctcagcaccacatcacacttgttctaaaattgaccacataattggaagtaaaacactcctcagcaaatgcaaaagaacagaaatcataacaaacagtctctcagactacatggaaactgaacaacctgctcctgaatgactactgggtaaataacaaaattaaggcagaaataaataagttctttgaaaccaatgagaacaaagacacaatgtaacagaatctctggagcacagttaagcagtgtttagagggaaatttatagcactaaatgctatagggaaagatctaaaatcaacaccctaacctcacaattaaaagaactagagatgcaagaccaaacaaagtcaaaagctagcagaagacaagaaataactaagatcagagaagaactgaaggagatagagacacgaaaaactcttcaaaaaatcaatgaatctaggagctggtttctaaaaaaagatcaacaaaatagatagaccactagccagactaacaaagaagaaaagagagaagaatcaaatagacacaataaaaaatggtaaatgggatatcatcaccgatcccacagaaatacaaactaccatcagagaatactataaacacctctacacaaataaactagaaaatctagaagaaattgataaattcctggacacatacaccctcccaagactaaactaggaagaagtcaaatccctgaatagatcaataacgagttctgaaattgaggcagttattaatagcctaccaactaaaaaaaagcccaggaccagatgaattcatagccgaattgtaacagaggtacaaagaggagctggtaccattccttctgaaactattccaaacaatagaaaaagagggactcctccttaactcattttatgaggccagcatcatcctgataccaaaacctggcagagacacaagaataaaagaaaatttcaggccaatatccttgatgaatattgatgcaaaaatactcaaaaaaatacttgcaaactgaatccagcagcacatcaaaaagcttatccaccatgatcaagtcagcttcatccctaggatgcaagactggttcaacatacacaaatcaatcaacgtaatccatcacataaacagaaccaatgacaaaaaccacatgattatctcaatagaggcagaaaaagccttcaataaaattcaacagcccttcatgctaaaaactctcagtcaactagatattgatggaatgtatctcaaaataataagagctatttatgacaaacccacagccaatatcatactgaatgagtaaaagctggaagtattccctttgaaaaccggcacaaaacaaggatgccctctctcaccacttctattcaacatagtattagaagttctgaccagggaaatcaggcaagagaaagaaataaagcataatcaaataggaagagaggaagtcaaattgtctctgtttgcagatgacatgattgtatatttagaaaaccccatcacctcagccccaaatctccttaagctgataagcagcttcagcaaagtctcaggatacaaaatcactgtgcaaaaatcacaaactttcctatacaccaataatagacaaacagccaaatcatgagtgaactcccattcacaactgctacaaagagaataaaatacctaggaatacaacttacaagggatgtgaaggacctcttcaaggagaactacaaaccactgctcaaggaaataagagacaacacaaacaaatggaaaaacattccatgctcatggattggaagaatcaatatcatgaaaatggccatactgtcccaagtaatttatagattcaatgctatccccattcaagctatcattgactttcttcacagaattagaaaaaactactttaaatttcatatggaaacaaaaaagagccctatggcctagacaaccctaagccaaaagaacaaagctggaggcatcacgctacctgacttcaaactatactataaggctacagtaaccaaaacagaggcctcagaagtaacaccatacatctacaaccagctgatctttgacaaacctgacaaaaacaagcaatggggaaaagattccctatttaataaatggtgttgggaaaactggctagccatatgcagaaatctgaaaccagaccccttccttacaccttatacaaaaattaactcaagatggattacagacttaaatgttagacctgaaaccataaaagtcctagaagaaagcctaggcaataccattctggacataggcatgggcaaagacttcatgactaaaacaccaaaagcaatgccaacaaaagccaaaattgacaaatgggatctaattaaactaaagagctctgcacagcaaaagaaactatcatcagagtgaacaggcaacctacaggacaggagaaaatttttgcaatctatccatctgacaaagggctaatatccagaatctacaagaaacttaaacaaattcacaagaagaaaacagacaactccatcaaaatgtgggcaaaggctatgaacagagacttctcaaaggaagacatttatgcagccaacacacatatgaaaaaaagctcatatggtcattagagaaatgcaaatcaaaaccacaatgagataccatctcatgccagttagaatggtgatcattaaaaagccaggaaacaacagatgctggagaggatgtggagaaacaggaaagcttttacactgttggttggagtataaattagttcaactactgtgaaagatagtgtggcaattcctcaaggatctagaaccagaaatatcatttgacccagcaatctcattactgggtatatatccaaaagattataaatcagtctactataaagacacatgcacgcatatgtttattgcagcactattcacaatagcaaagacttggaaccaacgcaaatgcccatcaatgatagaatggataaagaaaatgtggcacatatacaccatggaatagtatgcagccataaaaaaagatgagtccatgttctttgcagggacatggatgaagctggaaaccatcattcttagcaaactaacccaggaacagaaaacaaaacactgcacgttctcactcaaaagtgggagctgaacaatgagaacacatggacacagggaggggaacatcacacaccagggcctgtgggggttggggggctggggagggctagcattaggagaaatacctaatgcagatgacaggttgatgggtgcaaaccactatggcacgtgtatacctatgtaacaaacctgcacattctgcacatgtatcacagaacttaaagtataattttaaaaaaattaaaaaaagaaaactgcaggccaatatctctgataaatattgatacaaaaatcctcaacaaaatactcacaaactgaattcaacaatacattaaaaagatgactcattatgaccaagtgggatttatctcagggatgcaaggatgattcaacacacacaaatcaatcactgtgatatatcatatcaacagaatgaaggtcaaaaaccatattatcatttcaattaatgctgaaaaggcatttgataaagttcaacaccccttcttggtaaaaaaaataccctcaaaaactggatataaacggaatataccttttcataataaaagccatatatgatagacccacagctagtatcattctgaatgggaaaatactgaaagcttttcctattagatctggaacacgacaaggatgcccactttctccactgttattcaacatagtactgaaaatcttaactagagcaatcagacaacagaaaaaaaataaagggcatccaaattggaaaggaagaagctaaattatccttgtttgcagatgatatgaagttatagctggtaaaacctaaagattccaccaacaaaacaaaacctattagaactggtaaacaaattcagttaagttgtagtatacaaaatcaacatacaaaaatcagtaggatttcaatatgccaataatgaacaattggaaaaagaaatttaaaaagcaatcccatttacaatagccacacataaaataaactaggaattaaccaaataagtaaaagatctctataataaaaactataaaacactgatgaaagaaattgaagaggacaccaaaaaatggaaaggtattccatgttcatgaattggaagaatcaatatttttaagatgtccgtactgcccaaagtaatctacagattcaatacaatctgtatcaaaataccagtaatattcttcatagaaatagaaaaaagcaatcctaaaatttatgtggaaccacaaaaacccagaatagccaaagctatcctaagcaaagagaacaaaactagaggaatcacattacctgatttcaaattatactgcagagctacagtaaccaaaacagcatggtaccagcataaaaacagacacacagacaaaagtaacagaatagagaacccagaaataaatccacacacctacagtgaactcattttcgacaaagttgccaagaacagacattgaggaaaagacactcttcaataaattgtgctggggaaactggatatccatatgtagaataatgaaacttgatccctatctcttgccttgtacaaaaatcaattcaaaatagattaaagacttaaatctaaaacctcaaactatgaaactactacaagaaaatattggggaacctctccaggacattggtctgggcaaagatttcttcagtaatacctcacaagcacagccagccaaagcaaaaatgaacaaatgggattgcatcaagttaaaaagtttctacacagcaaaggaaacaatcaataaagtgaagaaacaacccagaaaataggagaaaatatttgcaaactacctatctcatgagagatgaataactagaatgtagaaggtgctcaaacaactaatcaagtaatccaattaaaaatgggcgaaagatttgaacagatatttttcaaaatgagacaaggaaatggtaaacaggcatataaaaaagtgctcaacattattgatcatcaaagaaatgcaaatccaaactacaatcttaccccagttaaaacggcttatatccaaaagaatgctggcgaggatgtggaaaaaggagaatcctcatacactattcatgggaaggtaaattagtacaaccattatggaaaacagtttggaggttcctcaaaaaagtaaaaataaaactaccactggatttagcaatcccactactgggtatatacccagaagaaaagaaatcagtgtatcaaagaggtatctgcactcccatgtttgttgcagcactgttcacaatagccaagatttggaagtgacctaagtgtccatcaacagatgaatggataaagaaaatgtggtacatatacacaatggagtactattcagccatacaaaaaataatgagattctgtcatttgcaacagcatggatggaactggaggccattaggttaagtgaaataagccaggcacagaaagacaaacatcacatgttctcacttatctgtgggatctaaatatcacaaaattgaattcatggagacaggcaatggaaggatggttatttgaggctgggaggggaataggagatcaggcggaggtagggaagggagcatagttaatgagtacaaaagaatagttacaaagaatgaataaaacctagtatttgctagcacaacagggaaactatagtaaataataatttaattgtataatttaaaataaatagagtatcattggattgtttgtaacacacaggataaatgtttgtgaggatggatatccaattttccatgatgtgatcagtatgcattgcagcctgtaccaaaatatgtcatgcaccccatgaatatatacacttactatgtacctacaaaattaaaataataaataaataaattgcctcagcaagaattccaataataaatgaagcctataatctaattttatatagacttcaattttaataaatatgttaacaaaaatttgagccctaaaaatatgttatcaatacgttaccacacaggacaaataaaaagacacaattgaatcaaaatcagaaatattagtggttacaaaataaatcagtttcaaactactcccagtaattaagatttgaatatataaataaaatgtttaatcataaggaaaacagtagtatcatttatacacagatcctcctcactttgcactatagtataggaccataaaaataactgtgcaagctgaaattgtacaatgcaatcttaataaccaatgggaaaatttacaattgttccatgacctttaaatatttttgttaaagtgttaaaaactctcttactgttggttatagttgcacggggaaataaaaaaattatagtagtattaatttagcacagtataattgaaaacattagaaattaaagcatcatttatttgaaaaaaattatcaaaattagtttgaaagtgtttgccttcttgttgttgtctaaattatcacactaagcaagcatatttcctatgccttggcaaattgtcatactcgcttctaagtatggatcaattcccaacattttatcctttgcactttcaatgtcatgaaatatttccaagaattcttctaatgtgaagttttttttttttgaaagtgtcacttcctctggaacatccttgtcctattcatcactactactttactcatttatgtctaaaagttcacctgcaataaatttccctggctgcatatgtagaatcttaaatgtcagcagtgtctcatgtccagctatttgttttaaaattcctatgttatcactactcctttatttgctgttctttcatctttgttagctaatacttcttttgattattcatctgtgtaaaatatcacataggtttatcactgcaaaacaaggaagcaacgcaactttactgtctgtacatgattgaagaatcaccaacagactgaatgaaatgacttgtctggtaattggtcacgatgcactccattacttatgtagtgatttgtggactaaagggccagtagcaaagtctgtactttatgtagttaatcatacttaatatactgtggcaaatgaaatatgaattgtgttgttcgggaactgacgctatgtaattaaattgtggtaaccaaaatatatgtatattggaaccagacaaagtaaggactgcctgcatatttatataatgttgagaattattctcaatgcccttatgttattaagtttatatatcaatggtttgctccttttaaaagtttcctcttctcccattaaatgggaagaacttatattcatggggataaagacttttccaacatatgagaaactattctacatagcacaaggcagcttctgtataatcacccccactctctatcataagcctcctttcacaaacttttaggtttcagaaatgtagaagcatatctctcgaactcataaaaatgctaaagaaattctggagactaaaggatttgcctctggcactccccttcttacaatcctgtagtacctctctactacataataatatactctacatgctttaacatggcctataaatccctttataatttagtccttcaatactcctcaagctttatctcttgacacctcctccctcacacttcatgattcatgaacaaagaagtgcttcttacctctcagcctttgcttatgcattatctatgtgtagatagcatacttgtccactaggtgcagtatcattaggataacttctgctcatcctcaagaatcatcttagatgtcacctctttccctgattcctgtatccatccacctttcacctccaggaagtttatgtgaacctccactatgtactataataatcctttcatatcttcataatcacacttgccatagcataatttatttacgtaatatataaatataataatttgtatatatttatataaatatataacatatatttatatatactgtaataatttatatatttacataatacataaatacaatttacatatttatataatatataataattaatttattataatactttaatgatttacttttgtataggttacatatcccttgcctgaaatgcttgggaccagagtgttttggattttgaaatttttcagattttggaacatttgcattataccacttgagactcccaaatctgaaaatctgaaatcttaaatgctcccagtgagcatttcctttgagcatcatgtggacgctcaaaataattcggattttggagcacttcggatttcaaatttttagatttaggatgctcagtctgaattttaaagacagtaaactggccgggcacggtggctcacgcctgtaatcccagcactttgggaggccgaggcgggcgaatcatgaggtcaggaaatcgagaccattctggctaacacggtgaaaccccgtctctattaaaaatacaaaaaaattagccaggggtggtggcgggcgcctgtagtcccagctactcgggaggctgaggcaggaaaatggcgtgaactcagaaggcggagcttgcagtgagccgagattgcaccactgcactccagcctgggcgacagagcgaggctccgtctcaaaaaaatatatatatataaataaataacctacttgaaggcaggaactatatatatcatatatatagttgatatatatatatatcaactctgtatcatatatgtatatcatttacataatagtggtttgctgaacaaatttcaggacaaaaagatgtgactaaaacaactgcagaattttagggttagttacagaatttatctgaggaagaaaactgcccttttgtttgaggcaactttcctggatcttttgcctctgtctagtcttgggaagctgaggcaaaggtggactaacaatcgcgcataatcatgtaaaaggcaacatcactgagtgatgagtaacaggttaactagttctacttagctaacctgaaataaaatgataggtggttggagccagaggatcagtgaaaataagacagcagagaggaggtggtgctttgagaagcaagccaaggtgaaggggcacagtaaactgaatttaagagcaacattttcattcattcactcataatatgtgcttgttacatgccagacactgaactgcaataccacagtgaatgaaatgtagtccttacattatacttaagcaacttataccatatttcctaaatccatatattttcccttagccactgttactgcattgttgtctaaaagccaacattaaattttctttctctgcagtgtaatatccttattctacaaattaggtaactacaactctctcgtaaagtttgtcaaatattacaggactcatgtcaccaatgcattgaggaatacaacaaaggcctataaccatggtttgaccaaaataaccagagaaaactatggcaaaattgagaaatagtgataaaataggatggtatagttatcaaaaaaagaatccctaagcaagaattgagaacaagatgaaaatcaacaaccaaaataatgtaagcacttcttggggtaagttcataaacttcctaatgttctaagaatagagattttaattatttttctaaaaaacattaaataaaagaataatcccagatagctggagaactttgggagacttaaattataggatgaatacaacacaaacctctctattctgtccaccttctcacttagaacatacttccctcaggcatacaacagactcatgccaatgttagtcccaaatttctcacaatattgacttgctaatctctttaagtagtacttggctttttccttggtcccatcgatccctagtatctctcaactagctctcacacagaaaaacagtatgatagatgaattcttgaaatgatgctaaatcacagataacagcttattctaagaacacagaaatattttaaaagacttctggaaactgaaatatttttagccaaatgaatttgtcattaatgttggaatttcaatcatatgagccagactgagggaaatatctttggacacagggaagttttcaaagtccccaaaactacgccactttggcaaccactggcttgcctgttggggagttcagcactgtgataccttgttctcagcttcccctaccattagtgggaatggcagattgcagagatggtaacagtggtggcagcacaacccccaagcagcggcatttgtattagactcagtactgcacttgaattgggaagcaactcaaagtaaaacacacctctgcagatttttataggaataataagccagtgagagatgatctatagagctggctatagaacagtagaattctccattatctttcttcaggcactgatttttatgccaactctgatttttttgtcattgtgcttatctatattcagtattaatatagctccttagtactatccttgctttaaaaagtttatgaagaactgcatacttttggggtgactgataagtcacagtgcattccacttgatgcttttggttgtttattcctgtccaactttatacagatacttactgtgtacctcctatgcaatgaaaagattcttttaaaaaataattgaacaaattctctcaaaataaaataaaaattcacactgatttataattctcactaaactgagaggatttttcaatattcaggaaaatattgccatatattatttataaaaatttgttttaaaatgtgtgcatcatatttcacaactgctctgagttgtggtaagaggtgcttaactacttcaatatggcttatcttcttgaacttagaaaaactgtttcaattagattgctaatgttcttacaattataaataaaaggcttcccattctaatatagcaactgattggctatatcaaataatttaaaaatccatcttgattccaaacgcagaattaggactcttgtcttccattcaaccaagcatgcactctggatcaaacttacctgttttttggcaaaaattcagacactcagtaagaactaaaaatatacttcagttcctagtaaaataagagttacatgaaggtagctaagttaaggcaaaataaccagtcaatctagggaaaacatattgcttgttaaaaatgttaatactggtttcaaaaaatgggaatggatggataaaaggggaaaaagaaagaagcaaaccaaaaaatctatgaaagactgaagagaatactgctgctaatttgcttgccttctctatctcaatttcactttcagttttcaagactttttttttacattaatcttctctttatttacctcaacagtttttatgagttgttagtgtatttcacataactttcttgcagacattttagctttaaggattacttgagtttggtttatattagacaaattttaatatttacaggtactttccagagaaaaagaaaaatgaagtcactgttatctgtcatccaaaactatatttgtttccttggctttcatgaaaaccagtattttacttcctcttgcaacatgctagaggtacacagatatacttaaataccactgtctaacaaatatcgaattaacgtgcttctggccagagtaacagacccatagccccaaacccagctccaagttggctgacctaccatgtgcatgcacatgtccctgacctgagaaacagcgtggcaagcccacccctgacaaagcctcaccaccaccaccagaaactctctcagcctaggctactgagacactcataaatgtcaccagcatggattacacctgaagaaactacatggagactacattactgtgttcacctagaaccaaagccaatatatcccaccaaaacaacaccccaagacttattcatatgaataagtctttccctaggaaacctactccataaaattagaagaggtaatttttccaccagatgtgtagaaatcattgtaggaacacatcaaacatgaaaaagcaaggaaacatcaaacctccaaaggaacagaataattcaccagtaacaggcatcaatcataaggaaatattgtatattcatattaaagtaagacataccataaggagtatgacacaaacttgtcccaagcctgcgaagtggagaattagtttaggcttaaatggagccattatatccttttcctagttatacttgtttttcaaaaatctgtatatagtttccattaatagagacactctgaaaagggggaaaatattccaagaaatattacaaaataatctcaaatatttcaacgctattctgaactactgtcaaatcacagtgaaccagggattcttcctttatcagaaagtaagtcactttctaaatactttcaactaaaccttatctcaagaagatcctgcaatagctcttaattgataatacgccaagatccctgacttctatcaggtctatttctatcagctaatactaaaagccagattgaaagctttttaaaaaatcttataagagaaacaagaaatctgtgaaagatattcaattcatggcccagtatgtttaaaataatgctgttatatgactttactagaaaaaaataattcaaaataatgttacatagaccaaaaagaatatattcttactattttaaaatactgatgggccatataacatgtacacgggtctctgaaagttagtaattctgctttaaacaagtacaacttcaaagttaaaatgataatctgctctaatggttaaaatcaaagtattttttgtctatgaataatatttactcccagagactgcatgtcatatactcttctatacaaaaactactcaacatttacttaatgtgtccttttctggagtgctaatttcatgaaccacagatatcatttaactacagaaagtaatgagtagtttattcttctgtcatgtacagtgtcactgcataggatgcaataactgtatatttaatatcaactaaagtaattgagatcatatccatattatgaggtcttctttgatgatatatgtcagtacaatctcctaagagatatgagtagtcagatgtatactcagtagcataaaataaacaggttcatgactgtatatcaagatcaattctgtcagaaaagatcactgcagtttcatgtctccttgcgggggcaaccaacaatctcaagggaattaccagattctaactaaggtctaggatgaagactagtctgaaggacattaaaataatggtgtggtcactcaaggtaaaatactctcatgagtaccttttcattattttacaattcagcactatagcaggggttatgaaggaaagcaaaagaggccagcattatttccaaaaccagataaatagctgacggtttacatttattaagggctgacaatttatgtgacacggtgttgcaaggattatctcattctgtcttctcccaaactccctatgaagtggatagtattatcttcacaatttacaaatgaggtaactgaagcttagaagttaagcaacctgcccaaagttgatggaacctacaaaatggcagttggggtttgaacgaagcaaccagggcctgaataccacttgcaacctaagtctcccaataggaaaggaatatggaacactaagacaacaacacagctcattattatatgtatttagatatccatatcaagtcaaatactgccctacaatattttggtgcttttaacaccttaagaagaaattttttattttcctcattccctgtagaaaatcaataacttagtgtttgggaaaaaacaagctgaccaggtagaaaagaagttatacttctgttaatccaggaaactaaaagatatattttataaaataaatattgcaactgtgtcagtactcctttctacctcacaaaaagcttagtcatatgaacatgactactgtttttcactagctgtccccaatcctcacgtcacttccatcctacccttcaagcctcacatctgtatatacctcaagacagagattattatttcccagtaaaatgagaaccccttaacaaatccatatgtattacctataagcaagtaaacctcactttgggcatataaaagtcataaagtgacttcaagatctcagaagtaggtcatttccctaatatagttttaaaaaggaaagcttcaatattctatcactgactttctcttgcatgtgaattctgtgcccattattaattgaagggtcttcttttatttttcataagattctgccttttgtgggcaccagtttccgggatgatgatggcatcctaattttcttttgctgagaaaaggaattttaaaacattagttttagggtcaacttcaaaatgagatcatagtcactgaagacctccaagatccatatatcatccaattatgtttcagaacaggtatccctgaagaaaaagacaaaaaaaagaaaaaaagaagaaaaaaagaaaagaagtaaaattccaacttaccttatcaccttgcataccaggggggcccattaatccagaaaggccttgatcaccctataaacaaaatacagacgtttaatgtcatgaaagagaactgaaaattagaattctcttgaaaattaaagctccttttaattttggacatcagctcttattacaatcatttccaatcttcacaatctttgagcctgtttctgaggcttcctgcctttccttatctcttccagggcttaataactgaactgtattttcccacctccatatccttgctccgttttctctgatgttcttttctgtaataatgcccttgctgtcaaacttcgcctcagtccaaggtctaccatgttttaaaaattgaaagtagggctgggcgcggtggcccaggcctgtaatcctagcactttgggaggccgagacaggtggactgcttgaggccaggagttcaaaaccagcctggccaacatggtgaaacccgtctctactaaaaatacaaaaaactagccgggcatggtgtcgggcacctgtaatcccacctactcaggaggctgaggccggaaaatcacttgaacccgggaggcagaggttgcagtgagccaagatctcgccactgcactccagcctcggcaacaagagtgaaactctgtctctgtctcagacaaaaagaaaaaaaattgaaagtagtttccctaaaaaatctacaagtgcattgtgaaacagctgttgaggtgtcacccctactccgtttctgtgagcacctgcagcctggtaggtctcccagagagaatctcacgggctgtggtgggaccagctaggttcacgtgacgcacaggaggcacttccgcttctggagctgagctggtgccttccatcctgcgtgccagctacacagaacgtccctcaccccggagtaacgagcgaaaattgattgggaagtccatcatgtgcttggctcgaacagactaggcgttaccgattagcgctaccttttttacatttattactctgatagaaggaagataaaactgcacaaggaaagaggaaactagaggctggtcctcttccactagctttagtcatgaaggaatcatttaatttctcctcagattcctcctctggaaaatgaggttgataatgatgatggtgatgatgattatgtcaatgtcatctcacctgtcttatgggaaaggaaaaacttacaccatttaaaaacgatctatgcatgctctttttaagctcccaaagggcttaaaaccttgtgtatgatctattacagatgttacttagtggatgttacatggtgaagtactaaatcctgcatttatttttctctttcaccattgaccatacatttattgttaaaaatggctaaatggttaaaatacaattgtttgcccacccccttctacttccaccaagttaatgtttatattttatttgtattcagatttatgtgtataaccagtttcctttttcctcagtatatttgaatccaatttaatgtaagtacaatttctaacagatcatttttaaattttaccattttaggaatacctctattaattttaaaagttggattttactaaagctctatggcaatatactattaaattttatatcttaatatgtttctgttatagttttaaccacagttagtatataagtaactcaaaaagtgaaaaaagactaacatgcttccaagtctgaattcccatattgaatcaccctatattttgctcagagaagccacagggaaagataaaaccaagcatttgatataaatatgaatgtttaatctaggggttttacttaaaatagtcaccaaaattgagtgggcctctaatttctaaattttaagttaagaaatcaaatatattatgtttagatattttaaaatatggcacttgtgtttctcatattgcagaattttgtccttgcaataattaagacagtaatgaaaatactatgtttatagtaataatctattccaagttatttagactcagtgaactcagttccaccacaataataaaattactaaaattttagatttaaaacatgttgagtatgtactcccaaaatgtgtgtaactattgtataccagtaaaaaatttaaaaacaaaataaaataattttttgaggatttactctttcatatagtatctgtagagtaattatgtttttttttaagtttacaattgtttctgtaagccaatgaaaagatcagatttcaaactttatgatagtttctgtaagccaataagatcagatcgattttgtaaccaccaaaattgttcagggatttttaaagtttgtgaatgtatactacattaaaaaacacatcccataattatattacatttataaagtgcctgtctaaacaaaacttcccagatgtcctcctaagactccatttgtatttatcctcactagaaaacagtatccttctcccaataaagtttttgtagttatctttgctttaaaactagtttttactaaaatatgtatatgtttgtattggcagtgttaggatgaaatgaaagcatactggacaagaagtccaaaaatttggatatatcatcaactctgtcatttactgtccatgtgataagtcagttaaaatctatgaattctgttttctcaatgggaaaacaagatagtggtgaccgcttctctcacagagagtaccatggtacttaaacatcataaagtatgtgaaactattctaaaaatatgtaaattggcattacaatttatatattattgtgtacatatgtattaacagcaaaatgtctgcagttaggaccacatcctgttgtaatttttaccccatccaccccctcattggcagatagtacagtggcaggccacagtagacctttaataaaagtaatgttaagacttaaatcaataagtgaaactggtgataaaatttacttaattcttcaaatagttcttccttcattaaaatccaacaattaattctcatgtttttttcctgtctgatacagtaaaatctacatttaaaaatgcttaaattattttaaaatgcttgaaatatattaccataatttcatttcatggtcaaataattaccttttctccaggaacaggttgacctggggaaaatcctggatctcctttggggccctaaataaaatagttataaaacagttggtgaagcataagttgcatataatgtgtcatatatcttcaggtatttattaccagatgttatatacattatatggtgttaaataaaataattttacattgagataggcattggttatttcattttttaatgtatatttttcttagccttatttttaaatgatgagaagattcctaaaagttctctagacatagttgattttttaatctaataaatttaaagttatactactattgaaacatttttcttgaaggacctaggtagatttattattttttccatttttgtgacatattgagttgttattcctattttagcattgaaagactattactttagtaaaagaaaacttcttataataatccttaaaattctaagatatcattccaagtttaaatattttccaaaatattacaatgcacatgtattacttttattattaagaaaaatgaacataaaaaagatacctctaatccacaaaattctttttattctgttataaaattagataagtttcacagtgtggggatctttatcttttacatttcaagataaatatgacattaggtttcagctaaagtttttgggtacaatatcaaaatatttttatgatgcatagtagcaaagtaactctttttcaaacaatttgtcatatctcaaaatataggggccacaatggagattctttaaaattcaaattctgattttattaccattctcaactaagaataaataattctccttcctagatacttctaaatactattttcactgggaaatagtcatatcttctttacatattcagagatgcttttaaatgacacttaagctgactgatgaaggatgaaataccaaaagaaaagtcctgcgtgtcccccagtaagtattttcattttacaaattagaaatgaaccctcactggcagagtcctgtattctatagtcaaagaaaaattctacattgtgtaaggaaggggggtccagttttaatgttctgtatatggctagccagtcatcccagcaccatttattgaatagggaatcctttccccattgctcgcttttgtcaggtttttcgaagatcagatagttgtaggtgtgcagtcttatttctgtgttctctattctattccattggtctatgtgtctgtggattaaagacttaaatgtaaaacccaaaactataaaaaccatggaagacaacctaggcaatatgatttagtacataggcacaggcaaagatttcatgatgaagacaccaaaggcaatcgcaaaaaaacaaaaattgacaaatgggatctaattaaaccaaagaggttctgcacagaaaaagaaactatcaacagtgtaaacaaacaacctacagaatgggagaacatttttgcaaactatgcatccaacaaaggtcaaatacccagcatgtataggaacttaaacaaatttaccagaaaaatacaaacaaccccattaaaaagtgtgcaagggatatgaaaagaaacttttcaaaagaggacataaatgcagccaacaagcatatgaaaaaaatctcaacattactgatcattagagaaatgcaattcaaaaccacaatgagataccgtctcacaacagacagaatggctattttgaaaaagtcaaaaaataacagatgctggtgacgttgcggagaaaaagaaatgcttatacactgttggtgggagtataaatcagttcacccattgcggaagacagtgtggcaattcctcaaagacctagagacagaaataccatttgactcagcaatcccattactgggtatatacccaaaggaatagaaatcattctgttataaagacaaatgcatgcatatgttcattgcagcagtattcacaatagaaatgacatgaaatcaacctatatgcccatcaatgatagactggataaagaaaatgtggtactgtatatacaccatggaatactatgcagccataaaaaagaatgagatcatgtcctttatagggacatggatggagctagaaatcattatccttagcatactcacacaggaacagaaaaccaaataccacatattctcacttataagtgagagctaaatgatgagaacacatggacacagagaggggaacaacagacatagggtgggaggtgggagaggatcaggaaaaataactaatgggaaccaggctcaatacctgggtgatgaaataatctgtacaagaaacccctaatgacacaatgttacatatgtaacaaacttgcacatgtacccctgaacttcaaatttttttttttctataaggaaagtttgtcttccaggttgacctctttttcatcatagccatcactgtttgctccactattaaggctacaattttaggtcattggttacaaggttatgaaacctaagaaatggctttggtgatatcttaatatttaaaaacttaactcatcatcaaaaaagttaatatacttagaatttataagagtaattagagcttatctagtaaaacatattttgtagataaaagaagcaataaagcccagaagagttaattgacttgctaaggattacttaggaaagtattggcaaacaatgtccattttctttcttgtatcacaatgcctattacaaatcttatctattggttttaatatattttaatcttttattataaaagctaactagttgattcaaggctataatttacaaagatttttaaaataagaaatgatagcccttgaaaagtttaaatataataaaaccctttgtggccaatgtttttattataaatatcatgttaaaaattcttacgtttagatcctatttgaattttctatcatctgtcagctttcttaatatcatcaaataatttaatgtttaatctccactttaaaaattgatagagtgggcaaaagtaatcaattgaacaataaaaattagattttaaagggtactttttcttcatgtgttatacatctgggcaacacatttgacacatatatgtcaaatttctctttgttctacacaaatatgattgagttaattgatcaactcatgttttagaatgggaatttcaagtcagtatggaggaaatgctcttaacttggctagttgtgggctgatccttcctaatataaaatgcatgcagcgaagactattgaataatgccaactttatctaaaatgtcaaggaagtagggcatgcttctctgcattgaaggagaaaactccaaaatttcttattttctccctcattttgtatcaactgttggactcttgacacacttttcatcttacttgattagtttttcaaatcccctttggaattatataaaatacttataaattcattaattaatcataactgactctgaacctcagtaccgacttccacttacttctgcatgacttttgttaaaggaagtatatatccttttgactatgagtaagaggaaaaggaaattgcctattctttgttactcaaagttccaactatcccactgatctgctagagtttaaaatcatttttatcagagtaagtcttttagtccattattgaatctccagagggccctcggtctagggagggaaagtccccaaggtagaggacccattaacatgttagaacagatttatcttagattagcatctgctcaatataattgaaagagcattgggatttggagtgaaaacaccaaacaattcatttaaactctcaatttgagatttcttctctgtaaactcgtattaataataatgagctttaggaccaaattctctatggattataaaggtattagtagtcagtactaaaattaacaggactaaaaacaattattattaaaatcacttttacaattgttgccatcttggaaagcagataacacaacttttgagtgaattattaatgaagcagcaaaactttaatagagaataatttggaatctaaaaattcagagtaggaatgaactaaattgtgagaatatcacaaaggaaacactaaatgacatgaccttgaggtagcatcatttggatattcttgactttgacattactaataaccacataagcttcataatctcaattacactctccaaccaacacttcctatctttagcccactcttcataggcctccacaactttaacatttatttgattcactttaacatttatttatttgaagctgctaatatgtggatcctaccacattttcattggttcatcccccttatggcctcgctttcctcctcagcctaaatacaagggtctaacatagtcactccattgcatacataaatgaccctacttcccctttctctctctgtcttataagcttacctggcaattcttaaatctaaattctatctattctgcacctgcctaacagccgaatgtgactaagagaaaaaattcatgttgacaaacttcactttaaattcataacttctttcattgtttggtcttttatttaatgtgtccaataattgtcttagtcaattcacattcccatttttatagatgattatttcataactccttctctttctttcctcttagctagtgatcttgtttttaatttttataagttctcacaaccaagtctactacctcaacctaactctgttctaaaatgctctgccttctctcattaaacagacaaatccaccattctttcaccaggctatcactgacgctctgtttttcctgcattattttaacttttacttctcttcagaataatttctatatacccaggataatttccattacagtaaacatactttaagttttgtcatcttaaaaaaagctttccttgagcctacatgtctcctttctgctccttatgctattcccttttagagtgaaactcctaagttgtttctgttagctaggagacctcctctccttttgttctctcttggacctactctacacagacttttttgtccctaccactatcctacttcacttatcattctttctcaatcttgttgttattgtattgttgttgttgttcttcttctccttctttcttctcttttctttcttcgtctttcttctcctttttctacttctcctcctccttcttcttctcctcctcccccctcctcttcctccctcctcctcctccctcctcctcctccctcctcctcccttctcctcctccctcctcctccctcctccctcctcctccctcctccctcctcctcccttctcctccccctcctcctcccccctcctcctccctcgtccttctccttctcctcctccttcttctttttcttattcttattcttcctcctcctcctcctccccttctcctcctcctcctccttcttcttcctcttcctcttcctatttattaaactctggagtaccccccataaggcttagtctttggacgttatctgcattcatccctagatgatctcatgaactctatatctttaaattccacatatacactgatgactgtaaactgtatttctagctatggcatgtcccctgaactccagatccaaatcctatttttaaatctccacttggatgttaaatagtgatctcagttgaatatgtccaagaaagagctcttggaaattctcgtccagatagtcacagagtagcatgtatgggatgaatcctcctgtagataatgattacaaagtcaggataagatacataaaacaacattatgtgagtatacaggagagcaaccaaaaacaggatacactggaggggattcaacccttgaaagggagacccatactttgtgtaatacatatttatacagcttgtctcctgaggatactccctagtctgcatggagtgactagaattaaagcagaaatagaccttttactaatggtgtcagaggtcagagtaaggggctaccagaatgactgtaaattggggaagaaaattaaaagaaagaaggaaaaagaagaaaggaaggaaagacagagaagcaagagaaagaaaggaaaggaaaggggaggggagcagaggagaggaaaggaaaggagaggaagaaaagaaaggagcttcccccaaatgctggatatagatttttcatccttggctgacactaacatgtgcttatatgaggtagactccaaagagctcaacagaagcaggtggaaggctgaaagaattgaacataaatatcagctgctggtcaccacaggggaaacagtttgggggtttagccacatccttttagaagaacatggtaaatactttggtaaacacctttccattgacattcaggaagggccatgctttagaagtaaatatgacatccttggactgagactcacaccaagagcaaaactgaaacaaatctgtcctttaaaaagttaccaagcccataagtttaaggtgactcttttggtaaaaagttaccaaacctttaagtttaaggtgatgaaccagttatttaactatctacagaataaaaatgaacagtcttcaattcaaaggacgtaacagaatctaacatctcttcaacgtatcatccacaatatccagtatatacaaaatcttctagacatacaaaaaaaatgggggaggggaaaatctgacctgaggttaacactatcattaaccaccataatctaattggcatttatataacaccacaccaaataactgcaaaatacacaatcttttgaagtatatgtagaatgttgacaaaaataggtcacatattgggccataaaatgccttggtaaattttaaaaggttaaattccaccagtatgtgctctctgatcaaaatggaactaaattagaaaaataataaagaaaacaacatacttctaaataagcaggtcaaaaaagaaattatatatttccgagtgataatgaaaatgtaacatatcaaattttgtgagatgcagttaaatctgtttttaaaggaaactttataactttaaatattagaagagaagaaaggtttataatcagtagtttagctttccaccttaagctggaaaatgaagaacaaattacatataaaataagcagaaggaagaaaataataaagagttgaaatcagtgaaatataatgtagtccatagagaaaattaacaaagccaaatattgactctttaaaatgattaatgaaaagttgttatttcctaccaggtgaaaccaagacaaaacatacaaagaaaaacctgcaaacatgttatttctcattatagcagataggaggtcccataatagcagctgttcaactgctcaagccttagcattatctttggctcttctctttcacactatatatgtaatctaccagcaaatcatgttgactgtaattcaaaatgtatctagattgtgaccacttctcaccacctcaactgctaatacctttatccatgccatcatcacaaatggcatggactagggatgactagcagagtagactcaactggtatccctgtttccacctgtctcccaccccaaactattctccacatgacagccagaagtatcctagaatattactggatgatgttatttgcctgcttagaactcttcaatgaatattcaacacaatcagaataaaatccgaccaaaatcttttttttaaaattttattattattatactttaagttttagggtacatgtgcactatacccaaaggattataaatcatgctgctataaagacacatgcacacgtatgtttattgcggcactattcacaatagcaaagacttggaaccaacccaaatgtccaacaatgatagactggattaagaaaacgtggcacaaatacaaccaaaatctttaccaatagaattggctcctactacctctctgatcatattcctgacacttaacctcattcagctattcttcaaagattgaatcaaggcctttggatttagtaaactgttgtttttcaatgttttcatcaggaatgccaaagtagtgatttttaattctagcattctttatttagtagctctttctataataagaaacttccatttatcaactattttgttatcctgaagttcaattctgtaaggaagggaggcaatttttaaaagtttgcttctttccttttatttttcttctatttaccattttttaaaataatgatgtggtataataaaatatatatatttggtttttgtccccagttcctggcatagagctcctaaactccttgaaatttcctgagtgataggggtgtcttttgttagtcataacaagccccttctgaccacaccagagtttatgctaataagatgacacacgctgggatccctaaatagctttcagcattggggtctggtcaccagaaagacacacaaatgattagagaatgggaactttcagccctactttcccctaccccctctgccagggaggggagagaggggctagaaattgggttataaaaactcttgaacaagatttgaagagcttctgttggtgaacatgttgatttcctgggaaggtggtatggtgggatagagcataaaagctccacactccccatccccaattctttgccttatgtctctctttcattaggctgttcctgagttgtatcctttacaataaactggtaaaagtaagtaaagtgttttcctgagttctctaaaccattctagtaaaatattgaatctgagaggatgggtcatgggaacccctgagcttgcagtttgtccaagcagaagtgtgcgtctgggcatctcatttttgtctggcatctgaagtgtgggaagtcttataggactcagtgttaaaaactgtggagatgatgctaactctggtaagctgttgtcagaactgaattgaattgttgcatatccaactggtgtcagaggatctgaggatcttacagatataattacccagcatcatcaaaagatgatcaatgactttgttgaagttgtatatcagcttaaggagctttgggtccaagactatggggttttctaggtatagaatcatattgtctgcaaacaaggatagtttgactccctctcttcctatttgggtgccctttatttctttctcttgcctattttgctccggccaggacttccagtactgtgttgaatagaagtggtgagagagggcatacttgtcttatgctggttttcaagggtaatgcttccagcttttgcccatccagtataatgttagctgtgcatctgtcatatatggttcttattattttgaagtatgtttcttcaatgccaggtttattgagagtttttaacatgaaggggtgttgaattttatcaaaagccttttctgcatctattgagataatcatgtggtttttgtctttaattctgtttatgtgatgaatcacatattgatttgcatatgttgaaacaaccttgcatggcagagataaagtctgcttgatcatagtggataagttttccaatgtgctgctggattcagtttgccagtattttgttgagaatttttgcatcaatgttcatcaaggatgttggcatacagttttcttttcttgtacctctgccaggttttagtatcgggatgatgctggcctcatttaatgagttagaaaggagtccttcctcctcaaatttttggaatagtttcagtaggaattgtaccagctcttttttgtacatctagtagaattttactacgaatctatctggtcctgagcttttttttttaaccaaaaaaaggctatttattactgattccattttggtgctcatttttggtctgttaaggaatgcaatttcttctgggttcattcttgggaaagtgtgtgtgtccaggaacttatcatttcttctaaattttccagttttggtgcatagaagtgtttataatattctctgatggttacttgtatttctgtgaggtcagtggtaatatcccctttgttgtttctaattgtgtttatatgaatcttttctcttcctttttattagtctagctagcagtctatttattttactaattttttcaaaaaaccagttccaggatttgttgatctttgaatgattttgcatgtctcaatctccttcagttcagctctgattttggttatttcttgtcttctgctaactttgaggttagttttctcttggttatccagttcttttagttgtgatattaggttgttaaattgagatatttctttttgatatgggtgtttagtgcaatacatttccccttaatactgccttagctgtgtggtagagattctgatattcgtatctttgttctcattagtttcaaagaacttcttcactcctgccttaatttcattgtttacccaaaagctgtgcaggagaaggttatttaatttcaatgtaattgtatggttttgagcaattttcttagcctggatttctaattttactttgctgtagtccaagagagtggttggtatgaattcaattcttttgcatttgctgaggattgttttacatccgattgtgtggtcaatgttagagtatgtgccatgtggtgatgagaagaatgtatattctgttgttttgggtggtgagttctgtagatgtctatcaggcccatttgatccagtgctgagttcaggtcctgaatatctttgttaattttctgcctcaatgatgtgtctaatactgtcagtggggtatgaaagtatcccactattattgcatgggaatctaaatctttttgaaggtctctaagaacttgctttatgaatctggttgctcctgtgttgggatgcatatatatttagaaaagttaggtcttcttgttgaattgaaccttttaccattatataatgcccttctttgtcttttttgatatttgctggcttaaagtctgttttgtccaaaattgggattgcaacccatgctttttttctgttttccatttgcttgatagatttttctttatctctttattttgagcctatgtgtgttactgcatgtaagatgaatctcttaaagacagcctaacattgagttttggttctttagcctgccactccgttccttttcattgagacatttagcctgtttacattcaagattagtattaatatatgtggatttgatactgtcttcatgatgttagctggtttttatgcagacttgtttgtgtggttgttttaaagtgtcactggtctgtgtacataagtgtgtttttgtagtggctggtaatggcccttcctttccatatttagtgtttccttcaggagctcttgtaaggcaggtctgatggtgattaactaactccctcagcatttgcttgtctgaaaaggatcttatttctcctttgcttacaaagcttagtttggctggatacaaaattcttggttggaatttcttttctttaagaacgttgaatattggcccccagtctcttctggcaatgtatggtttctgctgaaaggtctgctgttagtctgataggcttccctttctgggtgacctgacctttctctctagttgcctttaacatttttcctttcctttcaaccttggagaatctgacgattatgtgtcttggggatgatcttcttgggaggtatcttgccggggttctctgtatttcctaaatttgaattttggcctctctagctaggttagggaagttctcatggatgatatcctgaaatatgtttttcaagttgtttccattctccccatctctttcagcaataccaatgagtcatagatttggtctctttacatgatcccctatttctcaggggttttgttcattccttttcattcttttttctcatccttgtctgactgtcttatttcagaaagccagtcttcaagctctgagatctttcttcggcttggtctgttttaacacatgtgattgtattatgaaattcttatgtgtttttttcagctctatgagatcagttacattcttttctatactggctattttgcctgtcagctcctgtatcatttcattgtgattcttagcttccttggattgggtttgcgcttactgctgcatctcaatgatctttgttcctgttcatattctgaattctatttctgtcatttcagccatctcagcccagttcagaaccttgctgcagggctaatgcagtcatttggaggaaagaaggcactctgactttttaagttctcagagttcttgtactggttctttctcatctttgtgggctgatgttacttcagtctttgaaattgatgtcctttgaatggtttgtttttcttttatcctatttgatgaacttgagggttttattgtgatataaggctggctcagtcaactggcctcatttctggcagattttaagtggccaaggctcaactcacaactcctggactacatgctctaacactgagggactgatattgggccttgactttgttctctggcccttcaaggttaggatcccactgcaatgggaggagctaagttcctggaccattgatcacagcattccaatgggtagtgctagccaaagtgtttcatagggtggtagcagtgggatctgtccttgtttgcacatgccagcagcagcggccgagtggcaggatgctagcgggtgctgagagaccagcctccatgcaggtatttacagcagtggcagaggtagcatgactcaggaaggtgggggtcacactggtggtggtgttagcacagggacgaggcactggcaggtgcaggactgtgtgtgccctccgtacatgttcacacaggtggaggtggctgcacagggtgggagagggtccactgttctttgtgcctagtttcactccagtggcagtgttgacacaggggtggggtgctggcaggagcagggctggaaggctgtgtacctaccagggctccagctgcaatagcggtatggcagagggaggggaggtggagtgcacacacaccagctacagtgctatggcagggttcacatgcaaaaccggtggaacaaggaaggcaagatctgcctgcacacacatgcgttagcaaagcaatacggggagtggccatggaacctggggatgctgcagtgagggaaggaacaggtcagctgttgcgtgtccagagggccgctctgctggtcaggcacagtccaacagtgcaggagttatgatgcgggcccccagggccccagtctggctgcatctgtttgcagtccagcattgggtgccctgggaaaggccagcagatcaaggaaagctcagatcagaccagccccaggtgatagggaagaccaccctgcagagtttacatctgggctaaagttcccctaggggaacagtctcctatgggagcaagtgcagcctagggggattggcattcctggccatgctccaccacatatgctcctgtaacacaccctttgggctccacactggctgagtgctgctcctaccacttatctaagccgctctccctgtcaatgaagtggctgtggtggttgaggggtctcctcctgctgggattccagaggcctgtggtgaaagcaggttgctccttgccagttcaactcacctgttctccaggagtcgctggggtccatgaatgagtcccgatgtgaagtagcccctgtgcagagttcccagcttcctccctcttcagcccagcttctgtgtcttccctctgtccactctcagtgccctttctctacagatctgttaggagtgtgccagtcatcccgatcttcagtggcagctgttccacctggctgtgtctagtcagtcatcttgcccagctcccatatcattttttacattttcataatgttggacttactattttttatggcaatctgacccactacaaaattcttcttgtgggtaagcatctatacttaagatatttatttaattcatatagaaggaaaaattgtacttctagttaagataaatacacgatggagacataggagaagacagtcataaccagggatagaacatagcactaagatactactctttggtgttcaatactttatatatatactaatatattaaatattattaatgaaacattgttactgtgggttattaaggctagatgttttcatttaactggattaaatttgaaggaactattggccctgactaaattaatataagacatgaatgtttgtaggaaggttttaggcttcctccaagaggcctttttttggaaaagaactatcttgaccacagattgcctggactggaattgtaagcacatggtaggctgatgatacagactctacgtgcattcatcactcatgttcaaagatctacagcataattttacgtgtttaattaatagcaatgaacattcccatcgcgctgcaaataaatagaatacagttcatttaatagataaatatgataaataatagacccaggtggcatttgataacaagaaaaaagccattctctctggaaaacaggaaatggaatttagtttcttattttttttaagaagaacattgtttctaccatcagtctcctgatttcagccaatgatttcagctaatgatccccatagtctttctctattttaaatcatgttagttttacatgctgagaaaaattgctgcatatccactaaatttgtgtgtggcactttatatttctattgtttaacaatttaacaacacagtcctcagggattaggaatcagtttcactcttcatagaatttctatattactatcattatccacgggataacctggaaccttggaatataaccactttgttactattactaaataaattcataaagtctttaagttaggtaaccccaccactatcctgccttcttaaggtggtattttataaaagaattcctcattgtgttgggagagacaacctagtgtaagaaaaatactaagacatttccaattttgtctccccctctaccacttacaaacagtgttaccttggttaagcgcttactgctctcaagtgttttcttctgtgcaaaccagaaggtaataaagcctgctctcatagtacttatgattgggataaaactaaagagatatcatacataaaataagtggcagatattagataaaagaggattatacagtataaagcttgaatgttctattaattccgattattctagaaatgcatgttaagtacctaagaaaatcggtttcacaaaatcaaacactacaagctttatatgatacatttgtgacacaatggtaatttatttatttatttatttatttatttatttatttatttatttatagacggagtctgctccgtcgcccaggctggagtgcagtggcccgatcttggctcactgtaagctccgcctcccgggttcacgccattctcctgcctcagcctcctgagtagctgggactacaggcgcctcccaccacgcccggctaatttttttgtatttttagtagagacggggtttcaccgtgttagccaggatggtctcgatctcctgacctcgtgatctacccgcctcggcctcccaaagtggtaatttttaatacttgtcacaaatctactatcttccacaaatatatgcagttaaatcatggtcagttttagctagtttggacacagttatcaaattcttaaattaaatatgaattaaagactattgttcaggtttatatgactaaatccccaagaggcctaagtttttgcaaaataaatgtaagtttttaaatccctcatatgtgagttcataaaatatcttattggtgaatagttatagtcaaaattaagtccatcctactaaatataatgttaaagaagactcttgagattacattttcttctctcctaggtcattttaccacagacatatattaatactaaacagtatttaaaaacactgtttttaatatttttaaaatttatttttgatacatattttctgggtacatgtgataaataatttgatacgttcttataatcaaatcagggtaattgggctggatctctattacaatgtgtttaatcttggaacagagataattttagtttgatacaaagttcttcattttctcaaatattggcttctcaatatttatacacattttaagaagtcaatgaaatacaatactttccaccatctctagctttaactctcctcaccctattttccccattttttctttgtatttgcttctattctgaaacagcaacagagcttattaagaaaggactctcgggctggtcgcggtggctcacgcctgtactcccagcactttgggaggtcaaggcaggtggatcacctgaggtcaggaagtcgagaccagcctgatgaaaatggagaaaccccatctctactaaaaaaaaaaaaaaaaaaaaaaaaaaaaaattttaaattagccaggcatggtggcacatgcctgtaaccccagctactcaggaggctgcagcaggataatcgcttgaacccaggaggtggaggttgcagtgagccgagatcgcaccattgtactccagcctgggcaacaggagcaaaattccgtctcaaaaaaaaaaaaggattctctaaagggagagtaaattggtacttgccactgcagattgagagttaaattacaagagcctaactgttcgctactggctgaagtattaggctggtgcaaaagtaattgtggtttctgcctttttaatgggcaaaaaacagaactacttttgcaccaacctagaagggggagaagaataaaagccatgtggaaattctgtctccctgggtcttgtggagaggaggcaattagcaggaatataaactcactataaattcagccctgtggagaaatataatctgagcccttacagctactttaaccttactaaactaattataaagtccccaaatgaagctcgaagggctatgaaaccacaaactcaaaaagaaattcctaatttctttagaagccatctatcttcttccctattacttatccagacttgattttaaagagtcgtttttcctctctgaggcacttccattgaactcaaaaaaattttcaacacaggtgagaaattttggaaatttagatttgaattatccttgttatatgctattattacctattaataataatgataccacttatggcatcgtagcaccatgttaagagctttactcacattaatgtatttagccatcactacagcactatgagcaggtagcatgattctccccattttacagaaaaggaaagaagcttaatgagcctaagcaagcaatttgcttttagccattcaaattgaaagagttaagacttgaacccacatctgtcagactccaaaaattctattcttaaccccaatctatatgatttcatgtttacttctgaatgcgatcactgataagcagaggggtgagaccctcaaagattcatgaagttactggcaaccaagatcctaatccttatctaatcttcccccaacctctgtcatcactcatatgcacacttttttcttttcttctcttcttaatgcaatagactgaatgtttttcccttcaaaatttatatgttgaaacctaatcctcagtgtaatgataagtggggctcgtataaatgggattagtgcccttataaaagagaccccagagacatagctagttccttccattgtgtgatgacacattgagaaggctctgcctatgaaccagaaagcaagccttcagtagatactaaatcttctggtgctctaatcttggacttcccaggctccagaactgtgtgaactgtgagaaataaatttctgttgcttataaactactcagtttatggtattttgttacagcagcctgaaaaaactaagaaaatatatattgggaatgggaatattttattttatatattttaagggaatgggaatattttattttatatatatttaataaaaatatatacacaatggaaatgggaatatttcattttagtgggaaagtatgggaatggagatatcattaaatattttatgtttagtgatatctccattcccatgctttcaaggtaaccaacctgtgtacctgtattcttccatacgttttcctatgttcttactatttatcacactgttatctatcatattgagaggtgacaacatgctagcagccctcgcttgcttttggcgccttcttggcctcagcgtccactctggccgcgcttgaggagcccttcagcctgcccctgcactgtggaaggccctctccgtgctggcccaggagggagccagctccctctgcttgcggggaggtgtggagggagaggcgcaggcaggaactggggctgcgtgcggcgctcgcgagcgagcgcgagttccgggtgggcacaggcttggcaggccccacactcccagcggccccgggcagtgaggggcttagcacccaggccagcagctacagagggtgcgctgggtcccgcagcactgatggcccgcccgtgctgcgctcgaattctcgctgggcctcaaccgcctgcccgcagggcagggctccggacctgcagcccaccatgcccgacccccgccccccacaccccatgggctgccgcgcggcccaagcctccccagtgggggctccacctccttctccgtggtgcctggtcccatcgactgcccaagggctgaggagtgccggcaagtggagtgggactggcgggcagctccgaccgttgcccctgcatgacatccgctaggggaagccagctgggctcctgagtatggtggggacttggagaactttatgtctagctgaaggattgtacatgcgccaatcagcactctgtgtctagctccgggtttgcggatgcaccaatcagcactctgtatctagctaatctggtggggacttagagaacttttatgtctagctagaggattgtaaatgcaccagtcagcactctgtgtctagctcggggtttgtggatacaccaatcagcactctgtatctagctaatctggcggggacttggagaagttttatgtctagctagaggattgtaaatgcaccaatcagcactctgtgtctagctaaaggtttgtaaatgcaccaatcagtgctctgtgtctagctaatctagtggggacttggagaacttttatgtctagctagaggattgtaaatggaccaatcagcactcagtgtatagctcagggattgtaaatgcaccaatcagcactctgtgtctagctcaaggtttgtaaacacaccaatcagcaccctgtcaaaacagagcgatcagctctctgtaaaatggaccgatcagcaggatgtgggtgaagtcagaaaaggggataaaagcaggctgcccgagcccacaggggcaactggcttgggtccccttccacactgtggaagctttgttctttcactctttgcaataaatcttgctgctgctaactctttgggtctgcactgcctttatgagctgtaacactgtgaaagtctgcagcttcattcccgaggccagcgagaccacgaacccaccgggaggaatgaacaactccggataggaggaacgaacaactccagatgcgccgccttaagagctgtaacactaaccatgaacgtctgcagcttcactccttaagccagcaagatcaggaacccaccagaaggaagaaactgcgaacatgtccgaacatcagaaggaacaaactctggacacaccatctttaagaactgtaacactcaccgcgagggtccgtggcttcattcttgaagtcagtgagaccaagaacccaccaattccggacacaatatgactatcatacaactatgtacgctcatatatatagattttcaggttagttgttttcataaacatttgttcattctttaaacatcctcggttttttttcaggtaaaaataattagggaagtgtggagcaggtaaataatattttatttccttggtgtttatttacaaattaaaacgaccttaatttaaggtaaattactcaaatcataatcttatatttcagaggtttccatacattgccatcatatttttgataacaatgattttggaatactaagcaggcctatacctgattttactactaagaatataaatccaagtatggtgggctttcagaggaacctagctctctgccaggctaagacaatcatgttgaagaatcatgctctggaggtgacagagatccttgatgtatcaagacttgccttaaatgttagggatcttctttttaatatcaggaaaatcaggtgatactcattagcttaagttgcctgattagtagtcacttacctttggaccaggtaatccaggtaaaccaggatttccatgtggccctggtatgccctgcaagtaacgaaaaaagtcatcattcttggaacatactggaatggaacaaagtacaattgcttactttcctctcaacatgtgtgatccctttaagcacttgagtttttgcttatgttattatgtatgccttaaagacctacttacttcagcttatgccctatacctacccaaatttttcttcagatctcaactcatttttaaatcctagccacaagaacatgaagcaatatctctctcctactaatttccgtagaaatttcttcatgtaaaattcatttaccaattaattgtatattgcctcaggacatttcttatactgttctaatctgttacttaaatactttattgctgttctaactgccttatgacatgttctatttagccccaggattataaattctttgaaaagagactcttaaaaatattactagtgtagcacttaacacattgaatggttacactcgattaatatttagcaatttgattttgcatcactgataaattatataatctgaattcaaaaattgattctattttctgagtacctactatgtgctaggaactgtgttgatgttttgtgtttctcattactaatccttataacaatcctgcaaggttattatttttactcccatttaaaaatccggaaacttaagcgcatacaaccagtaagtagaggaacagatcaccctctccaagaaagccttccatgtctccaggttccctatgcttacttcaattttgtaccctacttctgtgctcttcagccatacctccctcttaagacataacatatagttaataattatttgtctttttaattctgaattaatagagcagaatacttcaggaagacagaggtgtcagcaatgcaaatattgaaaatgcatctagcaagatgaaaactaaagaaaaaagattaaattttggctgggtgtggtggcttacacctgtaattctagcactttgggaggccaaggcaggagcatcacttgagctcaggagtttgagaccagccagggcaacgcagcaagacctcatcactaccaaaaatcaaaaaactttgccaggcatagtggcccacacctgtagtcccagctaatcagaaagctgaggtgagaagatggcttcagccctggagatcaaggctacagtgagctatgatacccatcactgcactccagcctgggtgacagagtgagatcctgtctcacaaaaaaaaaaaaaaaaaaaaaaaaaagaaagaaaaaaatggttagatgttatgacttatgtcattggtaaccttcaaaaagtacattttaataaagtagatggaaaacatctatggggattaatgaataagttgctgatgtaaaagtaaggacaatggaatataaattattatttcacaaagctcagtagtacaaacaacagtgagccaaaacaatagctttaggaaaaattaatatcaatgaaagtttgggatttataaaagagggataacttgttggttgttgccaaataatataaaatttagggagagaaaaaatgtaaagttgcaacttttaagttagatgaggtgaaattaggaacacaagtaaaataactagccttgagcaaaacactctttcttccttaagagaatgagaattggacaaataaatggaagataaaaagtgaattagggaagataaaagtaaaaaagtaaactgccgtattatgagaacagatggagattctgaacctgaagttcatgctgttgagagtacaaccttagcagtggatagggaatagaattagtatgaaaattggcccagtttctcagaaaaataggatccaaattctcacagagaggtaggaggataggaatggttcatgggctagaggagaacgagcaaggtttagaaggggctatggaagaaatgtgataggtcatcaactacagagaattttttttaatgcaaaacagctagagcccaatgagaattcatcttaggcctcaaatggacaagagtttgatgtgactatggacaacttaaagtaatattttagagtaatttttctttataatctttgtatgttaaataaaaatcagaataaaaataaagtggattatataaaaggtatttgcatttgtcatacaattctttttctagctcattgaacaaagatgttttgtagtaaaatatccacactttttttaggtttgagagaaactaattttaacatagcaataagtcttttgttgggcctgtgtaacatgaaaaactactgctgatctttaatgcagcttttttcctcagggcagttattttctagtcaatagcttcagaattttccactatgtaatccaggaatgtactattttaaggcagcccacccctcttcatttccccaaacaaatgaatctcaccttagatattgcgatcactttataagtaagaataatgttacaagtagcaccagaacagccactaatttacacatttgatcatctttgttggacacgttcacagagaatgctttggctgtgtgtttacactcaaaataaactaggctgcatgtgttcttaagcttctcttgaattggctaaggtaggactaagtttgaagatccaggcaggtttccaaaggaagtacatactgtacaatactagaaaaaacatgttagaaagttacaaattctcactgccagcaggaaatatagcccatctacttacccgtggacctctcttccctgacggacctgggatacctgctggaccaggtggacccttggaaaacaaatgtcaagacattaggcatgatagtggacacatttattttcttacgagtctgaataagatttccacccaaagacaactctttttcagtccccagttcccagctggtgatgatttttaagtaacacgaacccccttaccctaatcagcaggggtgagttgaaactcaagtgtcccctttaatctggccagaaatggcagcaggaagtctatgacttatggttacagccaccgtatctggtttttaaagggaccacaactagtagttttgtgggtaattttttacctaaatttacttttactatggaagaaggaattcaatttagggtttggcgaccaacaactacaagtttttttcaaacacaattcagaagaagatttgctttgaaaaatgaaaacactggccattttatgtacttttaaaagaattataccaaggatctgtgtaatgtgttaaactgttataatgaaatccttcttgtatatccattaataaatctgacttataccaattgcagcacaccaggaagtcactaatagagttaaatgatttataaaataaagtatgaaagcaaaaactgatcaattgttacagtgttctgagttatttaaatgttaatttttaaacatatcaaataagaaataggacactacttctttacttctccatataatgttttatgttgtcttcttcacttactttaacaatcaactgtggaataataaatgctcatttgtgatatggttgaacacatattcattcattcatctgttcattcattcaattgttactgagcactctgtgatatggcattgttcttggtgtctatagagcataccatacacatattccacttaacaaatattcattcattattgcagtaaaaatagtacacgatttcaaattagacacatcagggttaaaatactagcctcaccagtaacaagcactgtgacctaatgtgctttatttttctttattgtaaaatttttatatatctatgctgattgcacataaaataaagagatgaatccaggttaaatcatatgtactttccaatatgtgacagttttttaacctacaatttcataatttcatacagtttaatctgcagcatggccaggtacacctaaaatgtacattgagtttcaaaggaggagagggaaaatggattgatgggaaaggatcattccaattcaaaaacacaagagggaaatgagtaaattatgttgaaaaaaataacagttattttgcatatttctcatctcacattttttgatattaactactccttgaaactttctcttttattagagtcatttgcagttttctgatattcattagatatttcagactgtccatgtttttcctttagttgcacttttttctcttaccccctaaatttataaaacttttcatgtatttcctaatattgagagagaaatgctatttctattcagcccctaactgagggcattctccttcctcagctgttcaaatattttagcagccattatcatatcactagcttccatcaaatcttgatattttactcattgtcaagaaaaattgactttcttttcaagttaattctggtcctgttgttataattaaaaatttagcagctgttgatttgaatttatgtccccaaaaataagagccagtaggagaaatcgcaactaaaatgaaaaagaaaatgaaaagttttctttaaaaatgtctagtttggtttagtgtcctgtctcactacttgtgacaaaagaaaacactattccattcacattggaaaggcagtttgctatggcttgcgtttgtgtcctcccaaaattcgtatgttgaaatcctaaacaaagtgatggtagtaggagatggggactttgggaggtgatgggtcagggattagtgtcctgtaaaagaggcataagggagttagttcattttcctcttccaccatgtgaggacacagcacgaaggtgccatctataaaccagaaacaggccctggccaactaccaaacatgccagcactttgatcttcaacttcccagcttccagaactgtgagaaataaatttctatagtgtataagcctcctagtttatggcattttgttacagcagcctgaactaactaagatgcaattaacattagatactggggggaaaaagaggtatagtttatgtcatgatataaatatttgaattgtttgataagcactaaattaaaatcaattctcacatgtcttcataattttgtggtttcaaaatcttttacaacatagtattaataggcattttctagataccagagaagaatcataatttttatagcatgacatttttgagaataaattattttctataaataaggttaagtactaaaaaaggcactttaactttcagattatttgttattaagagaaagtacaattccatttaaaaagtaatggttttgcaatcatacaatgtagattcaaatcatgcctcaatcatttactagctgaataaccttagacaagtcagttactctttctaagccttagtttcctcacctttaaaatattgatgatagaaatttacctttcagggttattgtgagtattaaagctattgtatataaaatacctgtcactgtgcttggcagtgatagtagttaaccagtaaacagtagtctaattaactttttttttttttcgagatggagtctcactctgtcacctaggctggagtatagtggcgtgatctcggctcactgcaacctccccttcttgggttcaagcaattctcctgcctcagcctctcgagtagctgggattacaggtgcgtgccaccatgcccagctaatttttttgtatttttagtagagacggggtttcaccatgttggtcaggctggtctcaaactcctgaccttgtgatccccctgccttggcctcccaaagtgctgggattacaggcgtgagccactgtgcctggcctaattaacttttttaaggtatgcataaggcacagcaatcactgagtaaatgttagatattattattactaggataatatatacattaaggtaaatctattcaatagtccaatacttctaaaagataataatccctggtcagttaatgttggaaatcctgcatcttacattccttttttaatttattcattcactcactcaataaatattataaagcatcaagccctcctggagtttgcagtctagataaaaagacatacattaacagataaatacataattacaaattttacttagtgacatggaggaaaagaaaaggcaaccaagaaagaggttaatatggtggacctaatttatattgtgatgtcagagaaggcttttctgaagaagtatttagttagacctaaaagattaatgggagctagaaaaaagaagaaaataaaatttcagaagataggaataaatgaatgaggccatgagtaaaacaaaacaaaactaataaaagacacagtcattttgaggaattaaaagaaaaactaatagagcaaggggaaaagtggggcaagaggcagttgcagaggtaagcaggggccatatcacatacctgcacaggtcaggatacagagtttgagtttaagtgctataaccttcttccactgaagaacttaagctgataaacaatgttatctgattcatctttttaaaagaacactagagaattttggtaaaagatgtcagagtgagaacattttgcagactactctccctccctcaaaaccagctgtaaacaacaaaaagcaccaaaagaagaaaacatcatctccagtgaaaaacgaaaggatcataaccacaaaccacaaaatatgaagattacctgcccaatactgagaaactttggagcgaaggtgttgagagataaccaaatccaaaaaactcctcagacctcaaaccttggatacatattagtcttgaaaatccacttttttgattatgataaggtttaagggaatgtgcaagccacaggaaatatgattcatgacccagtaaaaacccaacttcaaagagacaagagtagaaaaggtggagctgaagaagaacataccttttttatgttctacaaccagaatcctctctggtgagaggggacaaaagacaagaagagcacaaatccccctatcacttctgagacagcctgtgatacaaagggtttcgcaacaaattgtgcatgaacatgagacgacacatgcctctgggtagaagacaaaacaaatatggtaagatggtgttttaggcagcaatctaaatttgactctgtgtaccattccaccttacttccctatgcctctccatataccattctgaaacaaatcaccaagatacagttgcctttattttaaaaatgaataataaccagagagcaatcagtagaggatttataaatagatatttggaggaggggaaaagtgagaggacaggaaaataaatttaaagaacaaagctggaggcatcacgctacctgacttcaaactatactacaaggctacagtaaccaaaacagcatggtactggtaccaaaacaaagatatagaccaatggaacagaacagaggccttagaaataacaccacacatctacaactatctgatctttcacaaacctgacaaaaacaagaaatggagaaaggattccctatttaataaatgatgttgggaaaactgtctagccatatgtagaaagctgaaactggatccctgccttacaccttatacaaaaattaattcaagatggattaaagacttaaatgttagacctaaaaccataaaaatcctagaagaaaacttaggcaataccattcaggacacaggcatgggcaaggatttcatgacttaaacacaaaagcaatggcaacaaaagccaaaatagacaaatgggatctaattaaactcaagagcttctgcacagcaaaagaaactaccatcagagcgaacaggaaacctacagaatgggggaaaatttttgcaatctactcatctgacaaagggctaatatccagaatctacaaataacttaaacacatttacaagaaaaaatcaaacaaccccatcaaaaagtgggcaaaggatatgaacagacacttctcaaaagaagacatctatgcagccaacagacacatgacaaaatgctcatcatcactggtcatcagataaatgcaaatcaaaaccacaatgagataccatctcacaccagttagaatggcgatcattaaaaagtcaggaaataacaggtgctgtagaggatgtggagaaataggaatgctcttacactgttgatgggagtgtaaactagttcaaccattgtggaagacagtgtggcgattcctcaaggatctagaactagaaataccatttgacccagccatcccattactaggtatatatccaaaggattataaatcatgctgctataaagacacatgcacatgtatgtttactgtggcactattcacaatagcaaagacttggaaccaacccaaatgtccagcaatgatagactgcattaagaaaatgtggcacatacacaccatggaatagtatgcagccttaaaaaaggatgagttcatgtcctttgtagggacatggatgaagctggaaccatcattctgagcaaactatcacaaggacagaaaaccaaacatctcattttctcactcataggtggaaattgaagaatgagaacacttggacacagggtggggaacatcacacaccggggactgtcatggggtgaagggcagggggagggatagcattaggagaaatacctaatgtaaatgacgagttaatgggtgcagcaaaccaacatggcacatgtatacatatgtaacaaacctgcacattgtgcacatgtaccctagaacttaaagtataataaaaaaaaattctactcagtaccattgtttaaacatgaatttttaaagcattaattcactaacagtatccttttttattagcacataataaagagaataatcgttaatgtgaaaaaaattatttaccagaagaggaattactccatacaacagataaagagttcagttatataggtcactacatattcaaagaatgtcaagatgacattaacgtacaaaaataaagttcaaagaagagttgtgaaagatttaaaaaatatgaaagagcaaaaaagaaactctttgatgaaagccatgtcagagcaataaaaactgattaaatataatttaaaaatcaatgaagggataggaatatatagaataaatgagttcacacaaaatgaaatggaaaagagcaatcatgatgacacggttgtagaaaagataataaataccattcatcatcacaaatgacatttaacatatgcaaacttgtatgcctgaagaatttagaaaaatggaaccaaccaatatttggttattataaggggaggtctttctataatcttcagatcaaaataatcttctgatcaaaagagtattcccccaaaaacctgattcagaacctaataggtttaaagaacttcaaagataaagaactgcatgggtatataggcaggaaaaaattgttacttaaaagtaggaaaaaccaggctggcttcaggcttctgagtcacatctacttcaagaagcagtaaggcaattcctacaagttcattattttatcaccattcagtctctcattatctctctaaaatctacctttagtcttctacactgcgctgaagttaggattctcaaagttcaacaatgacttcttcatcaaaatatccaatagattatcgctttttctcagttctcattctctttgacttctctgtctcttttggccctgctgatcaattccttctcaaaagtctcttctttggctttttgatattgcttctttcatattttgatatcactattcttttctcctatctctctgacttctcatcacatttctgctttttctttctataaccaaaaagcaaacatccccctcatttgactggtgaccctatgccacattcctctctttgaaaatctatccaactctatagtttcaactataaaagtcaatagaaatactcccaaatctatatccccagccttgacatctattctttacttcagcttcttcaactcttctaacagcttaattaccaacagctctttaaatgtttcatttttctctcctaaaattgactttccctcttaattacagtttttaataatgatatcaccattctctcaatctgcaggcttaaaatttgatagtcatcttttattcttttcctttttgcttggtccctaggtcccattaatttcctagttctaccaagtcttcctacaaaatctcttgaatcctacttttcctttgcattttcactgctgccaacctagataatgttctagtcctttaacaccaagatggtaacagaaacttcgtatcctggacactgttaccagaccgattttccaattaatacctctgcttagaaacctacaaaattcccctttgagaacaagataaagttagaatgatcatttgacagttaagaatgcccacaacctgacaccatcaagcttggatctttatctgtctgctttagaggaagaaaacctggattcaaatcctggctctatcatttaccaacaatgtcattgtgggaaagtaaattaactctttgggcttcagtttcttcacctgaaaaatgaggataacactacaaactttacaaagttattttaagataatatatgtaaagagactggtagagcatctttctcaaggaactcaataaatgatagctattatgctatcataaaaaaaactcacctactcctctcacctgtcaaaatcttacccattcttagagcctaggtcataactaactttgtccacaagatcttattctgaatagctcagctttaagtgacctttcatagagactccatcaaaaaatactatttttttaacctttgaacatctctagcccatacacttactttgcatctctctgcagcatttatcctactttactacaagatatattaaatagttataaatgtacttcctttatcttcattatgaaatataagctttttctgagcaattactgagttatacatactttgtgttcctgctttgcttatagcagagactaagtaaatatctgctgaatattactgcttcacctgccaatactgaatgactatttttgaatttacagaagagattaatgctcatctgatcagactgactttttctgaagaaagtaaatggcttccataactatttgcttaatattatatgtccagtgattcaattttatgaccaatatgttgataattaattgtcatagttgaagagtttatttctctataatagtatagtcttcatattttatttttaaatgtctaaacatttactctagcaagagtgactcaatacctatcaaatcacttctaggaataaccacaaaggaaacacaagctaaaagactggcttcaccttctcccattctatgatttctagagctaagccaaagactcaaattttattttcattaaataaatactttaagatatattttaatctacttgaaattttgaaaaaaaataatttctaaagacataaaggtaaatttaagtatacaaatatgaagcataaaaagaatatttccaacactgtgattttaaatgactttaagtggtttttaaatgattttagaaatttttaaatgttgatctctaattcccacctatacaacaaaagaaattcagggctgaaaagttcagtttattatctcacagttttgtttacatgatattaaacaagtgccttggttgtttttttcccctcactgaattgactgataactggttctttttgtgttaggcaaggggagctttaattaacccataaacataaattgaccatatcactaaagacagtcaacgattcattacacaataatctctatctaaagtaagttttacactctattttaatccatttgatgctattttgctgtaagaatatttaatggatgtatttaatgtatttttctttaacctaccatatcttttatatacttctcttaacatgactatgcattctcctatggttttcaaaatataaatatattatctatatttagcagttgaaatcctgattgaatttcaactgaacaagaaaaacaaatagtttgcccactacttcaccagaattaagtcacctttcagcctaccagatgaagaacaaaagcacgatatttgagccagggttacattctggcagatatgttacagcaaccataaattcatttactgtgccagaatgcatttccatgacagactttatctgttatgtattgtttggtccagagaactctctttaaaatgtattttaaagagagtttaaaatgtaagttagcatattaggagatattaaaaaaaaaaaaacttacgggaggtccagtgtctccttttggccctctcagatactccatttcaagcattgtatttagatcctcataataataataatcataaagctcagtttcatagctattttcgatgggataagtagcatcaggataaaattcaccttctttccttagatcaaggtgattatccacagatggctcatttgtcactctatgcaagcttgtgtttaaaattggttgcatttccatgagttcgttagtgtgtagatttgctgtgatagccttcttgagattagtaattgtatcttgtttaatttgtggaagaatagatggcatcttcttaaacagtgacagaccagttactctatcatcatgttgtgtgatattgtcagacatgtttaggagagagctaaatttctctttggtattcatttttgcctcactgatgcgatgagtggtcactgacaggctgaaatttgtctgagtatcttcctcagtgatcatttctttggcctgaatcccatggtttgtgagatccacagcagagacatttcctgactgaagagaagataactgagatcttgatatctggtgttcttgtcttttatacacggtttcagaatcattttttatgatatttggaatgcttttgccttcagtaaatgtatcctctgacagtactttttcagcaaatagtttgggcgggggagagtgttccggtatctttgttggtatgagagttgtacaaggaatgcttgtttcaggttggtatttgtctgcttggcgacactgctgtttcacatatctgcagtagtctgcagatgcttctgcagaaggaataatatctaactgacatactattccttcaaaatggatagaattattattcatacttcctaaagtaaacacactattagaatcaaaggtctgaacttctggaatagtctctgtgctaaaatatttctttccacactcaacaaacattgagacactttggtttctaatagtaatggcaaatgagtgccattgctcatcatgaacactgtagttgaaaactgcaggctgctttcctctaatgtgtactactaattttttaggtagtaattgtactcctaattgcagtctatttttatttctaatgctgaagagaaatgcattgttcacccgatgtgactgtaacccagttaatattgtaaacggctgccccaagttgactggtaaaattttcacgaaaggtgtctcgatataagcatcatttttaaaaatgactcctgattctgttaaatggaccccctgaggtaacggtgtagatgctgatggtacagcagtcgctggtgatgagtgtcttacgtctttgcctccaaggcctagttgatgaagaatatctatgcctggaaatttaaaaaagagagagagaaagaatcttaattttatggattcaagtgttcatataaatgtttgaatatgataaaaatcttccttgtagcaacagtagtttctaaaataagcatgttctatcaataactaattatgggtaataagaaatagggagggggagagtaagacattatactcaataatttgaataaagtacatgcccctccccctacacacacaccaatctctaaacccaaaacttatttattattagtttatttattattttagagacagggtttccatctgttacccaggctggagtgcagcagcatgattatagctcactgcagccttgatatccggggctcaaaggatcctcccacctcagcctcccaagtagccagcactacaacggcatgccatcatacctggctaatttttgtatttttcatagagacagagtcttgctctattgcccaggatagtcttgaactcctaggcaaaagcaatcctcccacagcactgggattacaggtgtgaaccaccacgcctgatctccaaaatttaattagtttatctctcttgttttccattttactgattcttatttgtcacttcaatgaatatacatgttcaaagattcccagatcccatttgtttctttgatttagaacttaaaatttaatgaaatctgtgttaaagtgaaagtggagtcatacttccaaagataattgtgatttggaaaacattttataaattaggttcacacgatcccttaaagtataatttttcaggctgtttttccttctaaccttctgggaatttacaagttgcatggaagctttcccaatgcctactaccttaagtgtgtgctacgcttaaagtattctggttaccaaagtcctttgataattcccggacaaaagaatttaaattcattttattggtgatcactctggtttttctgtcccttccaagcttctctttcttccacttttccagtcctccagagtaacttttatccaacttttagactctttcaatatctattatgtaatacgcattttatataatatggatttgatataattgtggatttctctgatttattattcatcgtaatattaccaatagtatattgtttgtctcctttacccaattaaaagcttctggaaaactggatatgtctgattcattattggatctcttcagcaccttccttgcaaatagttctataatttcagaatgaatgaatttgtcccacagcaatctgaccaggtctcatattcacctctggagtcatataaatttaaatatcacttaaaaagaatgacaaattctgtctttaaaatacagaacagcatagtcagctgcatgatctttattattctttgggttataaatttcccatctgtatctttgtataaatataatcatctccaaccagaaatgttacagaattgtgataagtgaaaaaaataaaagtctttgaagattagccaggaacgtttggcatcaccttactttttccttttgtaggaaattagtagatatttgataatgcatgcttattacaaatagcaaaagataggagagaatctcatttcccaagtctcacaactgtgtacaacaatgaaataattactgaatgccattcctgtgtaatctagcaatgcaattaaaatgttttttaacagagatcttcacaaaacactcaagtgttttattttaaggttagaacaaccatcattttatcaataaaatagttgtaatttcatgacatttttaaaggatagcaatatttgtatctatgatattgtatgacaaacttttccaccaaaatattcctaacaccagtgtagaattatatgcacctccaggaatttagggacatatttcaaagaggccccacataatcaacaaaaaaatacctttgacttcttatgttttatcatcataattcacacaaaatttaaactttaatccataatatggctggttgtttcaatatacaatataaattacttatgagctaaatcagctaattgtactcatccccaatcttcagtgaaaatttacaccgccgaaactagctatgttagtctgtgacattggatatcctcacccaggtttacctaactctaaaggtatgcctagctcaatctgagaagtaaactatggaaggaaccctgcttctgtggaaatcacaatgcttaaatttaaagtatatatgatcataaagtatctgaaagctataattctgagataccaaataagctacatatgtaaaaaataatcatacatgtggtatatcaagggctgcacgctgccccaagaacatctccccttgcatttattaagaacccctgccatctagtgcttcgaatttctgaccctattatacagaaatatcattgggaggagtattatttgaaaactttaaaaagcatatgtgtgttttcaatgtttctttatatgtatattaatatgcttcctccaattctatttttagtggagctttgatgacaaatagctgttttttaaaaatcaaatgtgtttgaacacttattactgaataaatttcctgttattgaaccatgattgcatccctaaaataaaatcttattagttttacgttattcttttggtatctcactggattattgactaatagttttatgtagaatcactacatcaatatgtatgagttgactggtcagtgtttttctcttattgtcctatatttatcagacaataaaattgaaatttcattattttctatagcctaaaacaatttcagtaacctttgaaattacattttttcccaaaaagttacaaaaactcacctataaaccaaattgatcatgttggctctttcattgatagtgcttcattcactttcctaatctcttctatgttaattgatttagtctaattttccactgcaccttgagacaattttagaaatttatatttttctatgaaataataaatttcctctaggcttttacatgtattacccagaaatcttcacataataatcccttacaattatttttgttttcctatgtctgtggccctctgtctcatttctctaattttggttattttgctttatttattcttaagtctgtcattattggtcatttcaaatgtatacagccttcagatttatttatctactatttttgttcattttctctatcattaattttagaatttatctttattaattatctcttcccatttttttttgttttactcttttgctaatctctgaagatgaataattagtcctttatttttcttttcttgcttgataatgaaggcatttaagttatacattttcctgagtgctgctttagctgcatcccatagattttgatatgtagcattttcatttttgttgttttctggaaagtatttttatttgtattttctctttgacccaagtggtttaagaaaaaagttttaaattttcagttaggaaggtctttttgttttctgattttgttattaaaatctaacttaatagtattatgatcagagaatggtgtctaatcagcactttctttttcaaaactcaattagcctcataagtggtcaattttcaataacatttcataagcactcggaaaggtgtttgaaggtacaaaatttaatacataccagttagttgtacctcattgtttatgttatttatatcctctatattcttgtttatttttgtacaattaatctgccatcaactgagagataaagtatcttaccagtagtgtgtctatttggccttttctctcttgtggtctttgctttatgaatattgatgtcatggtttttatgcatagataatcatgcagttcacatatttattgagtactgcacctttcagaattacaaaaagaccttctatgtctagtttattgggttttatatttttggcattaccttaactggtagtaagactaagcttccctcatctgactttctttttgtttacatttgtctgatatacctttgcctttgtttttgttttcatctactgtgaaacactatgttttaggtaaagacaaagggattgtatttgttttttgatccagtctgaattgttttctttgaatgtataaactaaatctatctacatttgctaatattatggtttgtttaatctgttgtattattttatgttttaccactttaattttttgaagtctttcactatgtagtttgtttcctttgctttgctttgtgtatgccttttgagatttagaagggtttgtatttttattctaagggtttcctttaaaattttaaatgtatataatgcccccagtcctttcattacacatatctattaattctttcctttacacaatgttttattttcctccctttaaccctttcccataccttctaatattagtctataggagtatctttcatagtgtttatcttttcattcttaaatatccttatatttctttcatctaatttaccaactgtaaaatatttaattcccagcttcttcagataaggcaatcagcaaagttaatctactcttcctattcttcctctcttctcctaccatttttctgtaattgtaccattcctacattgttagtttgtatggcatttatatttttctttttcccacattttcttttgacaaatagagccagacttttgtagtagcttccccaatcacttctctttggctgaagtttatcctctattagtttcctcaagaaggtttacgggaacaacatttcccgagtgttggacttttcagaattgattttttgtagccttgtaccttaaatttcatgggatataaaattctttcatgatactttatttccttgaatatcttgcagctgctgttccatggttctcaggtagtctttctaaatctgaagtcagctaaatatttttctccttacaagtgactccgtagttatcaacattcttcaagagttgttctttatctttgaaatgcaggaattttataagaatatggcaccatattgaccattcttgataaatgtttccaggtgcatagtatgatcattcattgcacaggttcaaattttttttatttacttcagcaaacttttaatgaattgtatccttgaatattggttctatttcatagttttggttttcttttttatatatatactttaagttttagggtacatgtgcacaatgtgcaggtttgttacatatgtacacatgtgccatgttggtgtgctgcacccattaactcgtcattaacattaggtatgtctcctaatgccatccctcccccctccccccaccccacaaaggccccagtgtgtgatgttcaccttcctgtgttcatgtgttctcattgttcaattcccacctatgagtgagaacatgcagtgtttggttttttgtccttgtgatagtttgctgagaatgatggtttccagcttcatccatgtccctacaaaggacatgaactcatcattttttatggctgcatggtattccatggtgtatgtgtgctacattttcttaatccagtctatcattgttgaacatttgggttggttccaagtctttgatattgtgaatagtgccgcaataaacatatgtgtgcatgtgtctttatagcagcatgatttataatcttttgggtatatacccagtaatgggatggctggatcaaatggcatttctagttttagatccctgaggaatcgtcacactgatttccacaattgttgaactagtttacagtcccaccaacagtgtaaaagtgttcctatttctctacatcctcctctccagcacttgttgtttcctgactttttaatgatcaccattctaactggtgtgagatggtgtttcactgtgattttgatttgcatttctctgatggccagtgatgatgagcattttttcatgtgtctgttggctgcataaatgtcttattttgagaagtgtctgctcatatcctttgcccactttttgatggggttgtttgtttttttcttgtgaatttgtttgagttcattgtagattctggatattagccctttgtcagatgagtagattgcaaaaattttctcccattctgtaggttgcctgttcactgtgatagtagtttcttttgctgtgcagaagctctttagtgtagttagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccattttcagctttctacatgtggctagccagttttcccagcaccatttgttaaatagggaatcctttccccatttcttgtttttgtcagatttgttaaagatcagacagttgtagatatgtggcattatgtctgagggctctgttctgttccattggtctatatctctgttttggtaccagtaccatgctgttttggttactgtagctttgtggtatagtttgaagtcaggtagtgtgatgcctccagctttgttcttttggcttaggatggacttggcaatgcgggctcttttttggttccatatgaactttaaagtagttttttccagttctgtgaagaaagtcattggtagcttgatggggatggaattgaatctgtaaattaccttgggcagtatggccctttttcacgatattgattcttcctacctatgagcacggaatgttcttccattttttgtatcctcttatttcagtttgtagttctccttgaagaggtccttcgcatcccttgtaagctggattcctaggtattttattctctttgaagcaattgtgaatgggagttcactcatgatttggctctctgtttgtctgttggtgtataagaatgcttgtgatttttgcacattgattttgtatcctgagactttgctgaagttgcttatcagcttaaggagatttggggctgagacgatggggttttctagatatacaatcatgtcatctgcaaacagggacaatttgacttcctcttttcctaattgaataccctttatttccttctcctgcatgattgccctggccagaacttccaacactatgttgagtaggagtggtgagagagggcatccctgtcttgtgccaggtttcaaagggaatgcttccagtttttcccattcagtagatattggctgtgggtttgtcatagatagcacttattattttgagaaacgtcccatcaatacctaatttattgagagtttttagcatgaagcgctgttgaattttggcaaaggccttttctgcatctgttgagataatcatgtggttttcgtcattggctctgtttatatgctggattacgtttattgatttgtgtatgttgaaccagccttgcatcccagggatgaggcccacttgatcatggtggataagctttttgatgtgctgctggattcgttttgccagtattttattgaggatgtttgcattgatgttcatcagggatattggtctaaaattctttttttgttgtgtctctgccaggctttggtatcaggatgatgctggcctcatcaaatgagttagggaggattccctctttttctattgattggaatagtttcagaaggaatggtaccagctcctccttgtacctctggtagaattcggctgtgaatccatctggtcctggacttttttttggttgctaacctattaattattgcctcaatttcagagcctgttattggtctatgaagagattcaacttcttcctgctttcgtcttgggagggtgtatattttgaggaatttatccatttcttctagattttctagtttatatgggtagaggtgtttatagtattctctgatggtagtttatatttctgtgggatcggtggtgatatcccctttatcattttttattgcgtctatttgattcttctctgttttcttctttattggtcttgctggcggtttatcaattttgttgatcttttcaaaaaaccagctcctggattcattgattttttgaaggttttttgtgtctccatttccttcagttcttctctgatcttagttatttcttgctttctgctagcttttgaatgtgtttgctcttgcttctctagtgcttttcattgtgaagttaggatgtcaattttagatctttcctgctttctcttgtgggcatttagtgctataaatttccctctacacactgctttgaatgtgtcccagagattctggtatgttgtgtcttggttctcgttggtttcaaagaacatctttatttctgccttcatttcggtatgtacccagtagtcattcaggagcaggttgttcagtttccatgtagtcgtgcggttttcagtgagtttcttaatcctgagttctagtttgactgcactgtggcctgagagacaatttgttataatttttgttcttttacgtttgccgaggagtgctctacttctaactatgtggtcaattttggaataagtgcgatgtggtgctgagaagaatgcatattctgttgatttggggtggagagttctgtagatgtctattaggtccacttggtgcagagctgagttcaattcctggatatccttgttaaccttctgtctcgtggatctgtctaatgctgacattggggtgttaaagtctcccattattattgtgtgggagtctaagtctctttgtaggtctccaaggacttgctttatgaatctgggtgctcctgcattgggtgtatgtatatttaggagagttagctcttcttgttgaattgatccctttaccattacgtaatggccttctttgtctcttttgatccttgttggtttaaagtctgttttatcagaggctaggattgcaacctctgcctttttttgttttccatttgcttggtagatcttcctccatccctttattttgagcctatgtgtgtctctgcacgtgagatgggtttcctgaatacagcacactgatgtgtcttgactctttatccaatttgccggtctgtgtcttttaattggagcatttagcccatttacacttaagattaatattgttatgtatgaatttgatcctgtcattatgatgttagctggttattttgctcattagtttacgattttcttctttaaaaattcgtattatgagtatattgaatcattgttgtcttctatatgtctcatatatcatttctctataatcctttttattatgttctttaaattcatttttgtttgtttgattttcttatttgtctttactgtttcctacaaagtataacttccctttgtgctccttcccatttcatcttgatttatgagataatttttgtatgacttctttactgacttctacaagctcacaattcatatccttttaatatattgccttcttttacttttccctgagttctttcatttctgccttagtatctttctttgtgtaggtgataagggggacatatttggtcagaatatttgtcagtttaacagcaacatttttttgtgtgtacattctcatttttgctgcttttccttacatgtttccttattgtatatttctacttgtgctgtgccaactccttttgctcattaattcctagcctagcaacttatagaaagatgctggcagaagaagaggatgggctgtgacttccaagtctcaaaacccaaaggctctgctccggtactaccagtttcattctaaatggcttctagccccaccttcttctctaaaccaaatctagtccaggaggacttctgcagccagctctatatacaacccttcattctctttcctccatatccactcacattggtatatgcttcagaatgaatccttcatctcagtgagtagatttttgcattttctgagatctgtccccactcatccattttagctattatctgtgcttatttattatactttccccttggcagcttctgccttccccagaccctgtagcacttgtgtacaagggctaaatgtatattttggggtgtgtttctcaccttcaggaagtctggttttgctggtgctttctgaagtctcactattgaccttattccatatggcatctgcttttctgagcacattttggggatttgcagattatattagtcccctagttttgctgaaagtgatttttaagtttattatttcattcatttttttctattgtatgatatccaaggccaaaaatgggaagatagtatctcttggtttcaactttatacttaaagtctacacccatttcacaaatgaaaaatctctgaagcacagagagattaaataacttggtaaaggtcacacagctgataaatggtagcgatgcatttgagcccaatcaatatggctttaaggtctctgactgctccaccacacgacctctcagccattatattccccacaccactccacatatcccttggcaaatctcactaattaatcatggcagtattacttttaccccacagaaatctcagtggggaatactctctagatagccaccaaaattggtacctgaagtgaaatcatcaaattgtcatcctaattttaagctttcttacctgagtatgaatacacttagcaaatgtgtttgagcaagatcttaagagaagagagattaaagaacacttaagggtagaaggcacatatgactggagctgaggagaactgcagacaaaaaaaatgggggtgggcaagagaagaagaagaaaggctttcactcagaggtcagactctttaacatgtaatttatacctggacttggatatcaccaaattacaattaggggttgaatttagatatttcgtaccaatgtttacaagaaataactaagttgccggaagtaaattgcttgttttgtgagtggccctatataaaaaatcaatccagttcatgtcacttggaaaatcagttaccatttaaagaatattaatgatcaacccagcactatattaggtgctttacatttttaaaaaataagaattatagcagcatgtattaaatttccatgtaccaagcactattctaagaactttaatattttaagtcacataatttgcataacaactgtatgaagtaggcactgttgttatctacatgtgagagttaggaaaagtaagtcatagaaaagttaaattatttgcccaagcttacccagctagggagtgcagaggcagaatttgcatgcaggtcatctaaggccaacttcttaacatggtgaaatttaggaaaggtttgtgttaagtaacagcagaactgactgtatctccttcctttatttgcttctgaagtgtaaaataaatggtggtgtcaccaagacaacgacttgttcttttttctataaataccaggcctaatgacttcatccaaaccatggctgcaacaaccacatatgctgactcacaaacctctcttctgggcttgcatatccaattgtctattgaatttatccaatagaaatgagatgtttcaaaagcatttccacttcaatgtattttccccaaacctcatttttcttacttgagtgcttctctcagtgaagagtctcacaaccacacaagcaggcagaacaatcttttcatagtgtaaagtagattatgccagtcttctgaccaaaatcgtccaatggctttccatggtataagacacctatgccatttattctcttcttatctctctgatcacatctcctatcattttatcttacctaattttgctccagccaaactagtattttccttcattcttaaacccacccaactaattttaaactcatggcatttgtacttactgttctttcttgggacgctttaaacccgtgtattgattttaatctgtatccttaactgtgaatatattgattttaatctgtatccttgtattgattttaatctgtattcttaactgtgaatacaacacttcagtgaactctctgagtataacgaattttggtaagttctgtgagtccttctaaagtattactgaggctgagagtagtcttggggaccccttaacttgaagctagtgtcagaagtaagggtggtctttgggacagctctctaactttatactaccctgatatggtttggctgtgtcctcacccaaatctcatcttgaattcccacatgttgtgggagggacctggtgggaggtgattgaaccaggtctttcccatgtttttctcgcaatagtgaatgggtttcactagatctgatggttttttaagggggagtttccctgcacaggctctctctttgcctgctgccatcgaggtaagatgtgacttgctcctcctggccttccaccatgattgtgaggcctccctagctatatggaactgtaagtccactaaacctctttcttttgtaaattgcccagtcttgagtatgtctttatcagcagcatgaaaacagattaagacataccccttacttatttttctcttcactgatatatctgctcacttcacagcattctccactctctgtatgtactcttccttgaatttcttgccataacaaagcttatctgcttttttttttatctcatcccgtcagagccctgctaagtatatcccttcatgccaatctttactcatcctgcaaggctcagttcaagtggttacctcccctttaagtcatcagcgcaatttttgtttgttgttgtttcgttaaacactgatgagaaatagatcctctcttagtatgctaataaaatcagtcttctaagcttacaaagctgacatactatataaacacagacagcccaaacttacttgcctttcatttgaaacttgtagagtaagcagcactgatgttgttatcacaagttagaataaaagaaagatgagggagaaggagaaaggggggggagagggaggagagagaagtagtagatcgagaaagagggatggagaaagagtgagggagaaaggtgaaattaagtcttagtagaggataaaactatgactcataaccaagtctttgactctaaactcagtgactatatcaattgactctgtggggggaatatagtatatgcctaaagaaatagatatgggagatccaatggttataactcattttacaagtacagagaaccaaagaaccattaaatgtgtcaatattcagcgatagtctatcacaaattggaagaagaagaattgtactattatgtttactacctcaaaatggacagatttttacatctcttagtaattggtagtttaaaatacttaaaagaaagttaccaatttttagataaaaaggagtaatatatcgctttataaagtataacaagttacagagttaactcttaactattaaataactaaattaatataacatagcacttaaatttaatgaattctcactgtttaaaattttcatatgtcttgatcagttacatcccaaagctatattctttccagtttgtaggaaagaacaaatatgactgtttaaaataaaatcaccaaatttgcaaatgagaatgattatagacttcgacacacttttctttttcttgccaatttacttaaactgactaaattaactagataattgcccaatattcattttgtattattttttatagtctcagctaaatagtcaatatcagaatcaagactcaaatacagcttcctagctccagttcactgaattaaggaactaaaggaaactgtttaaaataaaccattttattttattttttcaatattatgaggatatgggaaaagaaaaggatctggagtattccccttcttctaatcaaagttattgtatccttatgtaacaggcactgtgctaagcactttacatgtgttattttatccacacgacagccttgtgtagtaagtattactattttcttcactttagcattgttaaaaatgaggctcagagagtatttaagaaacttgctcaaggtcagttagctaataaatggcggaaactgggcttaactctaagatgctggctctggaacacctgtgcttaaataccactgtcacactgggtatgttaaaggtggcaatcgtttcttagaagtattcttactttaaatagcacatctattctgtataaagagataaatgctaatttatttataaaatgagaaatgaagctctaagctgtgtatagaagttttggctaagtgcccatacaagtgtttgtgaagaaaggacttgaagttactgcagctacaatgaactgcttctgttaacaataaacacatttcagattaatttctatgggaaattcttcgagatgaatattctacacagagatttttacacacgtggttttcacacctagggatcatgaacctgagaaagatgtgcatgttaagaattagttacacattatgcatggtgcaagtcattgtagagaagtgttgtagctatgccaacatctcactggcagccatcccaccaacacagacaaagtaataacaaaaatacacatatcaggtaagaaaaggtatctacatctgtcaaatcctcagaaaactcagacttacataattaatttttctggagatagaatcatttattcattagattacacctaaaacttggacataaaaaatatacaatttacatctattaataaggtacttaaaatgttttttcttagctgtgttaaaatttaagggaatttactgaaaccgtgacaaatcacatagatgcttatttcttctcattcttaaaatcttactcaaatgagaataaggaaatgtggtttagaactacagggaaaaagttaatgagtagaagagacaacagcagacaaaatatatcaacaaatttttggaaaatgaaaagcacacgaagaaattaccagagctgaaaaaactgaacctaagggcttcagaggcaaatgctaatgacaggcaggctgattcatattgcaaaatcctgaaaaggctcaagaattgaaggcaccaaatcaatgaattcagcattgaggcttcaaattgggggttgaggatatgtgagggtggaggattgaaagtttgtataagaagtttccagactaaaggagaccaaaggttaatgacatagaagcattgaatcaatcgtagaggaaaatggaagggaagctctgtattgagaagggatttggctaaaattgacatacaaaattgtgagacaatcctccccccatcaacccaagaacctctttatatcactgaactctaataacagtggcaaccaggattatattctacaagtaaggtattggaggatccttctctacatgccttagacatgtgtagcctaacaaaatagtcagacaggtttctacttaatcatcctctatgtgaaacatctcagttaactagcctacccatgcaaacagttgttaagcatatttttagtgtcttacttttttttttttttttgagacagagtctcactctgtcagccaggctggagtgcactggcacgatctcagcgccctgcaacctctgtctcctgggctcgagtagttcttctgccttagcctcccaagtaggtgggattacaggcatatgccaccacatccggctaatgtttttgtattttccagtagagatggggtttcaccattttggccaggctcgaactcctgacctcagataatgtacccgcctcagtctcccaaagtgctgggattacaagcatgagcctcgcatctggccagtgtcttacttttaaatgataacagaaatgttgcatacttataaacaacttctccaacataaaagacagaccaatacaaaaatttagaacaaagacaatgcagagagcagaagaaaagttgaaaaaatcgtcattcttatccttacagagataaaagtagacattgcatcaaagaaacgagaacaggatgaaaaaaaaaaagactagtctcagtgaaaaaacccttaaaaatttaaacacagaggccaggcgctgtggctcacgcctgtaatcccagcactttgggaggccgaggcgggaggatcacgagatcaggagatcgagaccatcctggctaacacggtgaaaccctgtctctactaaaaatacaaaaaattagctgggcgtggtggtgggtgcctgtagtcccagctactcgggaggctgaggcaggagaatggcgtgaacctgggaggcagagcttgcagtgagccgagattgcgccactgcactccagcctggacgacagagtgagacactgcctcaaaaaaaaaaacaaaaaacaaaaaacaaaaaaaacaatttaaacacagaagaaataagaaattaaacaaaatgtttggaatagtaagtgatgaaaaatctcacataaagtagtacataaaacaaagacggaaaataggatctaaaaataagaaaataaagagcccaatactgaagatttaatatttaaaagatattgaagaaagaggaaataaatatatcaggaagaaaaacataacgcaggaaaattcccagaaaattaaggatgcttccacactgaaaaggcctactaagtgcctagcacaatgaattgtaaaaagacctgtaccaagacagattattgtaaccttccaaaacatcaaagataaatagatgatcttaagggattaaaagggaaattaaaaggtcacatataaaggatcaagaattaatataacatcagatttaaaaagtctgcaagccagataaaaaaaggcaaaagatgaaaatatttcaaattctgagggaataatatttacagcctaaaattttatactcacctgaactacctgtaagactgagaataaacacattctcagaaatggaatgttgtaaaaaatgcaccacccaagtgcatattctcaggatgcaactagaggatgtgctgcacccaaataaataaggaaatagactatgaaaaatgacataagacttccaagaaactccatctaacacagatatcagctctactggaagcttagagaactactggtccatagcagagcagaattttagcatgcagaaggaatatctccaagaaaagaatcaaatttctggagtacttggtgcgtttgggggaaaatatatttcaaaatatctgagatttagtgatagtgacatagaacataaagcaaacagaaaaggaggcaatcttgttaattcacaagaaaaaaatataaacgtacatggctcagtgataaaaaaatatacacatggtcataataagctgaattgtgaatattaaattaaccaaaaattggataaaactatattgagagaatagaagtagggaaaggagacacagagaatagtaatgttaagtcctcatcattaataataggaagtcaatataatatttaaacatattatagtattaaatatagatgttaaaaccaaaagaaggtgctaaaagagtttgggcagacaatagtaggagtgggtaaggggaagggacactgctttttgctatatgttttgtcatacaatttggcctttaaactttgtacagtacttgtaattctttgatatacttttttaagttttgaaaaatctcataagcatacaaatatttatttctgataagtctaacttaggataatctctcactcaaacatattcagcagtattaatataaataatatctgtgatcatataaaaacacaatttatctgataatggttttccagtctcctgattagatgttacaaattgcatcgtgccaatttaatcagaaaatttcttttaggaaaaaagtgtttctaagtttctgataatatgctatttccatttctttttttgtgctcaaaaatattcaattttctaaagtctgagaggttttctaaaggacttttctttttgttaagaactggcaataaaattttaggtgtataaaattgaaaattatgatgcttgccctgaaataaaataacatattttacattccataaatgagatcttaagggtgagagaaatatgttgtttctttcatttattccttttgttggttctagatttttaaaaaataagttcataaatatttaattttccctatatctttctttgcatgggtttctaatattttgataataatatctttggtaaattattaaactcataatgccagtggctggcaactgtgaagctagaggacgtctaagggaaagagttttgtcttcagagacggacagacctagattcaaatctaagctgtaggtgagccacttctttgagtctcagtttcttcatctataatacctactctgcaggttcattatgatgattagaataatatatgtaaagtaccagcaaaagagatgatacaaaatatacatttaattaataattgtattcttctcttccttatcttctctgtggctctaggagcctcaattttaaggaatttgtagactttgcagtcaaaatatgagctcaaatcttggttcttccattcattaagcttttacttggaggtggttacctattctccttaatctcagtttcagcaattctatcatggccataattacaaaaccctgtgatgaggcagcagtgaagtaaatgtacattctaatagcacagtgactagtagctcatagtaagttctcagaaacagtaaccgtgataataacaataaattaagagagagagtttttctcctcttcatggctacttcaagctaaatgaagtaacataaatgccttggttaagaatagtttttcatgaagttacatgtgacatgtggcttaatcatttcccataaaagagatttagaaaatgtcttctaagaaatattttaattcatctatgtgatatttgaaagaatatttatctgtatctacttgtcaatttggtcaaccagagtaccactcttcctttttgccctctctctaccttgcacatatttcattcataatttgtttacttgtctttttcttactgttatttgatcaattgatcaaactgacaaggggttcatcaaactgaccactcaactgaaaacttggttctgtaagaattaatgctttggcagctctgtgcagaagagccctttgctacctttaaggcagaggagaaaaacaaacaaacaaatctgaggccttggtaatattatctgtaggtccagcacagttctaggatttgtctctttgactttggtatgttttttacctttgataaaggcatttttttcactttgatgctacagacattatcttatttacatttccaatcattggcaataggatattacacaggaaatagaagatgcatcaatcatgtttaaatgaatgaattaggatatacatagactcctgaaactctatcatcatactaccagagtaattaactagtaggcacaaacaaaacaggtttaggtttattttctaaacctctccatttgaattacatagaatcctaagcccactagtatgcaaattccattttgtttcttaatgatgcaaatctggacggaacattttttatatgcttttgttgtatcaagaagtgcaaaggtaattcagtcacagtttgccacccccaagaactcccacttaaaatgaagtcacaagcaaagcctttttattgtacaaaacttcttttttatagagtttgcttaaaaatgtaagcaatttcacagacggaagatatgagtaatttcttaaaggtcgtatttcccctcaaaattggtttctttaatcttacattctcatggtactgggtggaatttttgttattgtttaatgttgaatttacagttataatgagttgaaagttatgtacttttgctgtctggaagtagaatttttaagtaagcaaataaattaaaaggtaattttcttaccttgttcttgtgcatgaacaaccaccccagccacacatagtacaataaaatgaagaagtgatttcctaggaaaagaaaaaagcatttgggaaaaacttactagttggacatttacaaccatatagaatccaaaacagtctatgcaagattaagaattaagcaattattttaaatagcatgatattttaatattcatagtggttaagaccaaaggctctgaagtgaaattccagttttgccacttactatgtgacttgggcacatttttaatcattctatgccttagctgctttatctgttaaacctatctcataagattttctgaagattaacttaaaaacttcatgtaaagcacagaaaacagtacctggcacataggaaacattcaataaatatgaactagtataggtggtattattatcatatattatgttaaattaccatatatgcaatttcatacaaagtaatagaaatttccacaaaaataacgcaaattacagttgcttaactatagtgattataagttaatggaaccagctatttatttgtttaatggttatatgtgaaagccatttgaatatcatacttaaatcactcgtactagattcatgattttttggttttgaaaatagcaatggcctgtagatgtcaacattgagcattttgattagtagtagctatgagcacaatacccaatcactacaaattaaaatgtccattagtattgataagctatctaagcaaaaatgttttgtgacattgctagtataaccaaacttttaataaattttgttgaacattcttcataattggctgtatctacctccaaaatgaaaattacagaaataattttgaagagagatgataagcatgctgaaaacaatacttcattacctaattttgctaatatagaccctgattctgtttttgattctaacccagggactgttcaaatgatgtatttgtaaaatgcagttccgcaaggagtgattatggagctgtctataaaccattaattcccttttattaaattcctgatgtactagtagtaattggtacattttctatttattactaataagatgttttttacctttaccaactagtataaggagcatcttaatgtaagaaagatgatctttttacaaagcttaagccagcaaatatataattcgactatttataatggaacacaaatttcatttgtattaaaatggtatttatcctttgttagtaattttaaaattgaacattctatggccgtactcagtccagagcacagctcttataagacaaggtttcgatagaatacttaacaactgtcactaactctacaaacagatcaactgaatcattgcagagatttcagctgatatggataaataactaaaccatatattctaatgaggcctatgaaacattcttatatatggcattattcatgtagatggatggttcccaaatgttagactcacctgaggaacttgtaaaaaatgcagattttgggccctgacacagagattatgattcaaaaatttgcgatggatatgcaggatgcatacattttaactaggtgattctagtgcagattgtacgtgtgccaaactctgagaaaaaactatttagaacattcactgtgtttatatttacaatgttattaaaatacatctaaattgattttacttttgcttaaatcacatatatctaattttataacatgacatgaccctaaaatattatttggcccttttaaaatcctttcctactgcactaggtcagtggttttcaaactttagtgtgatcagaatcgcatgaagcacttgtgagcaatcactgggcctcacccccagaatttctaactaagtatgtctggggtggggctcaagaatatgcatttataacaagttcctgggtgtactgacgctactgatctgggactacattctgaggaccactactctaaaataaatgaccctcaagagatgatataaagtcctcctgtttggatctttttaccccttggctgcacactggaattacctggggagttttgttttgtttttgtttttgtttttgctttcttgagatggagttcgctctttgttacccagtctggagtgcagtggagcgatctcagctcactgcaacctctgcttgccaggttcaagcaattctcctgtctcagcctcctgaatagctggaattacaggcgcctgccaccacacccggctaattttttttttattatactttaagttttagggtacaagtgcacaatgtgcaggttagttacatatgtatacatgtgccatgctggtgcgctgcacccactaactcgtcatctagcatgaggtatatctcccaatgctatccctcccccttccccccaccccacaacactccccagagtgtgatgttccccttcctgtgcccatgtgttttcattgttcaattcccacctatgagtgagaatatgcagtgtttggttttttgttcttgtggtagtttactgagaatgatgatttccaatttcatccatgtccctacaaaggacatgaactcatcatttctcatggctgcatagtattccatggtgtatatgtgccacattttcttaatccagtctatcattgttggacatttgggttggttccaagtctttgctattgtgaataacgccgcaataaacatacgtgtgcatgtgtctttatagcagcatgatttatagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactgcacacccggctaatttttgtatttttagtagagacagagtttcaccatgttggccaggctggtctcgaactcctgacctcaggtgatctgcctgcttcagcctcccaaagtgctgggattacaggcatgagccaccatgcctggcccacctggggagttttaaaaactaataattggatctttctctccttgccccacagagattctgattttaatgtgtccataacacaggcattttaaaacattttccactgattctaatgtgcaaacaaggttgaggaccatcacgcaagattaaaatgatgtgtgggctctccaggatgtatcctaatatgatttagagcttgagtaaggaggctatttacctttcaaatttatgtttcaacatataactggcaggatacatatcagcgagactagaaaactgcttacttaggattacagtcaatgaaggatagtgcatctcaattatgctgtcttaagtataaagttgaatgtgaatggaagcatgtctcacctgcccaaggtaatcagcctcactcagatgcatagaaacaacccaacaggcacttttcccttaaaaataactaatgacaagtacaacagccagcactactcatttagcaattcaacaaactcataaacttccccaatgacctcagtggagaaaaatggaaataaacatgttaacaagtccattcctggtgtgaggcaggaaaacctgagcacatcaagcatcattctttagacaggtgatcctaggggattatgacaaaccagttgagccataccttgcataaatgtacctgtgtatgaaagctgatgactaatggactggtagagatcaatgactgaaatagattctctttctctttgtctagttacaaccaaaacaaatagcgaactgaaaaagaacaggtaaagtttcttacaatgcattcaagacccttattatttagcttcaatttccttttttagcagtatggatcccactacccctgatatctccaaagttccagccatacaaagttattctccatccactggaaagaccttgtatatgtctgaaatgccctaccagtctccacttaccattcttaagtacacccaaagcctaattaaatcaatacttgctccatgaagtttcccatcatctctaaaggggaatgaatctttcccccacctctgtacttttgatacattaattgtgactttgttatactcctataagtcctaccttttatgaaagtaaatatctgagcaagcagcaggtcttcatttttacctctagtgtacccatgtgttacatgaaattgacagtaaatactttttaaaaggaaatgatcaaaagtattatctcccaatgactgaggaattcactttttccttatggacttgattcttttaacacttggaaaaaataaaataaaatacaggcaattttagttagatgtccaaagaaagagaagggaaatagaattttttaaatctgctatggtagcatatatggtagccttcttcttttttttcttaattttcattttagctttcttgtctctgaagtgggtacaacagagaaaggatgaagtttcattgacatagtcagtttgataaagagccaaaccattattgtatatgggtatttaatgaatccaagattcttgggaaatgtctgatggactaggtttgtttgtttctttggattttcctccttatgatgttacatttattatacatttcctcaacaaataaaacttatcaagtttccacattagcagtagatggtagagtcctctatggaagcagctgttctttgtccttctgggtcttagctgactcatctatcatgtgatgacataatacaaattttatgtttttgtgttttacattccaaatgtaaaatcctataatttgtgtgtgtgatgggatcacattagtatactggcattaaaagacaaaaagcaaattacttagcaaaatgttatatatataggtgtgtgtgtgtgtgtatacacatacatatatataaagggtttgtatatatgtgtgtgtgtgtgtgtatacacatacatatatataaagcgtttgttatttaaccacaaaactgtaacggtcttcctatagttttggtccaatactatttaagtaacctaaaatagtctactaagttgttaattcattcatatatttagtttactcccacaaacagtctagttggtatattaaacatgaacaatttttgaatattcaaaacatgtttgttttcattcactggtttgtatatgtggaccatgtgtcactaatacaaagttatagagttatagttactcagacatttaacaaaatcagaccatatccaaaataaatcaacaatatggtaacaaacacttcataaaggctcaaaaaatataacccaagatattgatagctaacaaaataagaaacactctgcatgagtctggctgctagtcacattttcactttgacaccagcaacagtccaaacataaccagacatgtgagggtaaaggcctaaagaggataagacagaaaatagatatccaaagaccatactcagaacatgtaaatgactaatacccattccaggcatcgttcctagatgattcttagagctattcaacttcctctttattcaaaagatccaagttgctttaggggaatccgagggatcttttgcttagggtacccctgagactctaaggtattataacttatgtcttcaggctactgatgctcacttctacatagattcaatttataatagtgggaaggacttgtgaaatcttgtgaatagacaactttttatgagttggtggccttcttttaaaccaattgaaaatggtgaacaaatctgaaagacacacacacgtgatatacatcaataatttcaacaatttccaccacgctacgtttacatgccaaaaacttctctaagtcatgacagctttacagattttgctctttactagctactaagatcgagaaatagtaaaatttctgttctttcctctcaaaataactgaaaaaagagttttcatcacagcagtggacataaagttggatgattcagggagcaaagtagtactgtcactaacttacttgcaattaatttttcagactattaattcaactcaggtggtagttatatagctaaaccagcatgaagcatactacaggttgagcacccccaatctaaaaatccaaagtcctaaatgctccaaaatctgaaaggttttgagggctgaaatgatgccatactggaatcattttacacctgactttatgggtcacagtcaaaacttcatttcatgcacaaaattactaaaaatattatataaaattaacttcagtctatgtgtataaggtatatatgatacataagtgaatttcatgttttgacttgggtcccatccccaagatatctcattatatatatgcaaatattccaaaatccaaaaaaattcaaaatcccaaacacttctggtctcaggcattttagatgagcagtactcaacctgtagagcttttggttaaattctaagcattcaagcaattcatgcagtgcaagggagataaatgcttaagaacttcatttaatcaaagtgtctagagtccagtcagtaggagggaagaaaaatacatctaaactagtctgtcctagtaataccacagagaatgttaaactattgcctagcttagtaaagttcctggcacatactagtgttagataaagattttcaagtgaactaatgaatcagataatcttcagtcaatgaaagtatcaggtggtcttgagtttcaacaaatacataacttatctagcatcttctacctatacactcatcccaaaatcaagaaaagtcaagtctccccaacctctgcttgttaaacatggtttaaaggcctttccaaatctggtctctgtttatctctccagctccagctccagtcactgcttccctagaatgtgtactccaaccaacttcatttctttcaggccctcaaatgcactgtgctgtctcacttctgagctttttattgttccttctgtctggtaaatttcatgttcttttcagtaaggtctcagtctagatttcatttcctttggttaccttttccttccagtattatcctttcctcccctacccacccacccaagactgctaggtgcccctcatgtatatatcctcctctcatttcgttatacttggttgtttcatttgctatttcctttattagactggagagcagcaactgtggatctgtcatactcaatcattgtatctctgctgcctagaaccacactgggcccatagttggagctcagtaaacatgtgttgaataaatacgttaatgaatgatgaataaatgaatgacagaataatgttagccttttatgagaatgaaaataaaattgtctttacttctcattagagttacaaattctaaaataagtcatagttggaaggcatggcaaggaaactagcacagctattctaattcccataataacatttacttttattctgccgttcacaaattaccaagtagaatgtctaaatgacactcaaaagtactttccataaattagatttactctccctgagacatcagcttattttaaaaatttatttgaacacaaatataactaagcaactttaaaaaatagaatttcgtgccatctaggaaatagatctttatattccaaaattcctttttggttataaaagtctttaattaccataatagcctgcctcagagaccttctgataatatgtcaaattaaggtatctaaagctgactttgagatttcattaattttattaattctacaaattcacgttaggcaacccatataaaagaccccacaaaagaaagtgtcgtaaagatccacttttaaactggaactgtttttgggtgactaataagaactgtgattttaaaaagcgctccctctcttacaaaacatcaccacaaaaggaaaataaaactcagggatttcatcagagactctaaggtttaattcagtggcctgacattataaatcagctacttcttccaaatccagcccccccgccccaccccgcctcaaactccgaagggttggtggcattatttttcaaagggaaaaattccaaattatttatgaaaattggattttctagaaacaattttttcagtccaatcattagctatctttcccaagtttgcatgtgtggttggagctgtgagttctgtaatctgatgtaattatgaattacccttaattctctgcagcccatccccagtggcccctgtaacagaacaaattggatattatgagataaccaagggctgcaaggcctctggtggtcatgggagacaaacaccttcatccagaacctgctacttatccccatgtctctgcacaagggttctcttcccattccacgttttataatttttcttcagaagttcctccggtgcaatccattctatttggtttctctgcctccctccccccaaatcatctggacccaatttacaaaccccaaactgcccaagaatttatgcagggccttttctgggagcgtctggaagggaagtgtaaaccagacaagacaaaacccaggagcagatctgctttaactccggtggttggtcacaactaccaaggggagtgttagtcaccagcgtgggcctcgcgcggtggcagagggaaagccctcggggcaggagctgcaggagggccgcatgcggaggctggctgggcaagaagtggagggcctcactccgcctctcctggagtctccaggctggcagggctagagcctctctgcatccgcccctgatcagcgggaagatctgtcagttccgcaggatcggctgcaacccccgactctccaggctggtccacacagagggatgtttatcgagaacagtggcgggaaatcttctgcctgggaaccccatgcgacctgcgtgagccgctctgagaaggcaacccgcagagcttgacctctactcgctccagggactccccagcctccagcaccccgctgcccgcacggggttgaggagattgggaggtttcctcttcactgttgcatggggatgggggtgtgcggggaggtgcatgtggtcagctgggaagcccagcagcgaggcttccaggggtcggaagagagcgcgcgcgcgagccccagccaggctgggctgcacgcggctgggaagcacatgttcatacaaacacgaccacaaggcgctctttctccgcaccctgcctccgcctgccctcagctgacacggtcaattctgttccttgccctcctcccacctagcctcctgaggggcagcctctctgcagaagacttccacagccgcgttcacccttctcgcccaggggccagaagcaaacttgtgtaacccactgacctcttccagggggaccagggcatccagccaaagccgcgcaacccctggtccgagcccttttcccagggaaggcatgggagcaggtacagcgcccaaaggggaggtggggtgcccgtcaggacccgcccaaaacctccgcaggaggggcaggcccgcccccgtgtcctgctcccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctccatcaggctcagcagaaccagggggtggagagaggggttggtctaacccctaccctacccggcgggtgggctacttacgtttttgccgtgggggagacttttccacgccttgttctgtgggctcttaaatgcatttgtatgcatttgtccgtgcagcaaagcgctaacggaaaaca

SEQ ID NO: 2251 - DNA, 50350 bp, Homo sapiens
ctcaagctttgtctgctttatttcactacattaagttaagcaataaggcaaaacagtaacctgtcattcataaagatcaaggagtacctctctgtcccaaaagggaccaaaaagggtgtttcttcacaaatatgcatgacacttagctcattatgctgataagcacttcaaacaaaagaaaaggtcagtaggtgaatcaagtaacaaatccaaattaacttagcctaagtttccaaagctgtagtttcaagtgctaatgggatctaactttcctgtggtggtgcatactgactagcattaaaatttttgcacctcatctaatataaaaaaggcaacaaatacaattcctaattcaccagctgcaggtattgaatcatttctacgaacacacagaatactagcttacactaaaacctatcttgaggaaacattaaaccagtggctctattattctgcaagttagtttggcttctgaagaaaaaagtttatgatcaaagtgttttgtgtttctgtgtatgggaatgatgagacccatacttcaacattattactttggggaataaataccagctacctgccataaacgcatgacatgtgtgtagtctatgcaaacgtgtaaacatatgaagctattctctactctatgcccatttcctccactggcaaatatggagcagtgatttcacagtaggctctagcaggtagtgaaataaaaatttgagactctgtggggtcacaaaaaaatgaaactctttctatagtctgcaaatctgtaattacccatccccctgctccaactcctaagaggctaaatgttattaccataatgttagagatgagtattttccttcttacactgcatcacatatattactctgtaggactgtttcataaaattggcttgacctttgtacaattagtacaatttagtgtcttttagagtacaatttagtgtcttttaaaagcttcctaaatatttaaaacattttcaagggaagcttacaaggactatgtcccatctgtattctacattataatgttatctttaattttttaagacttaaaacaagaccaaggtaaacaaaaaatctgtattttcctcaagtctcttggccacttactaacaatacttttacagaaaacacggtgcagctggtggtctactttatcaagtttcattttagaaaacatcatagaaattaaggttagcaacccaactccaggataccaagtgaaaacagcaagtctgctgttaggccagaactgtgggctacttgctgaactattttatggtttacaatcaaaatggtcttatttgactcaccacatgacaaaagtcttaaacttagtaagggggaaagttcttaatatccagttttggattcaagagattataatagttaatttccccttcaaatcaatggaaagaatgctagttgagaatattctaaaaatctagcctttaaaatgttttctgcattccagaaatgaacctgtccactcaggttttctttgggttcttttccaggtcccaaacagaacaacttaactgagttaaagaggcagaacagggaaggggtaggaagtaagacaaataaagattgcccccctgtggcagcattaatccctgggtattgtggcaatattgaaaacgaatggaatctgctacccccttgacatgacatgtaattgtttgcttctcaaattcttcttaaaagatccatattttactgggaaaaaaattaagaacaactaatacgtgtcctgtattcacttagaaaaagagggcaaatgagagtgccttaacaacttcacaggtttttccaatcatcatgatactaaagataaagtgacaattcagtttttcagttatatggaaatctatggcaaaatggcagccattatggcaatgaagggatatgttttagactgttagatgatatttaacggaatgcagaaagcagttggtacattgtgaccaatgctggatcattaacagcaggtctacctttgggttatcatttaagtttcatctgtgacattgtgatccttagtgagatcagatcaagagacagtacagagtttctcaggtggtaaatacaatgccattccaaggaacacccatcccctttcctaggatggaattatgctgctgttactcaacgtgcagggttcagtgagggagacacagacttactggtgtcaacaggggtgagagcaagagcaacagcagctaccctgtgttcccaatgccttgcctatgctcccactttcttagcaatagaattccgtagtgcatgggtacatcgttataaacaaggcctaatgaagcagcagcttccacattttaacgcaggtttacggtgatactgtcctttgggatctgccctccagtggaaccttttaaggaagaagtgggcccaagctaagttccacatgctgggtgagccagatgacttctgttccctggtcactttcttcaatggggcgaatgggggctgccaggtttttaaaatcatgcttcatcttgaagcacacggtcacttcaccctcctcacgctgtggtgtaactttgatgaaaatacccactttgttggcctttctgaaggctataatgctatggaaagaaaaaaaagcaagtattaggtagataaaaaaatcagccaaaccactaagacttacagtaaaagtctttcaccttattctttccttcagcacacacagaaaacctataaacactttgttcttaacctaccaagtatttttttgttttgttttgagacacagtctcgctctgtcgcccaggctggagtgcaatggctccaccttgggtcactgcaacctctgtttcacgggctcaagtaactctcccatctcagcctcccgagtagctgggactacaggcatgcaccaccacacctggctagctttatatattaatacgtatattttttggtggagatggggtttcgccacgttgcccaggctggtctcgaacaccagggctcaggtgatctgcttgccttggcctccaaaagtgctgggattacgggcataagccaacacgttggccatatatttttctatgagcttatacttttctgcttttctaaccaacacagatggtacacactattccataacttgcttttttttaactctgtttatcacaaacaccttttgacgctggtatatacagatcatctacaatctatgtaatggttgcacagtattcaattatgtgtttaccataattggcatatactgaggttgctgacaacttttctctattataaacaatggtgctgcaaacatccctttacatttacctctgtgcaaatgcaatatttctatagaacatagactcataccgtggaaagttatttatttatttatttttttgagatggagtctcgctctgtcacccaggctggagtgcagtggcgcaatcttggctcaccgcaacctccgcctcctgggttccagcgattctcctgcctcggcctcctgagtagctgggattacaggtgcacaccatcacgcccagctaatttttataattttagtagagatggggtttcaccacattggtcagactggtctcgaactcctgatctcaggtgatccacccgcctcagcctcccaaagtgctgggatcacaagcataagccaatgcacccggccttatttttattttttagagacaaggttttgctctgttacccaggctggagagcagtggcacgatcatagttcatggtagccttgacctcctaagctcaaatgatccttctgccttggcctcccaaagtgctgggattataggcatgagccaccatgcctggccatactgtgggaagttttaataactcagtgctttaagggaaattttggaacaccataaatcaagaatgtttttgtaaataacttatgtaattaggaattttagcacaaaaatgtctcttcattgaggtttgcatttcaatttcccctcatttgtgcatacagtttgtgctttaataacttagtttctgaaagtaaaagggcaatgaaataaacagaatttgtctactacccaaatgacattcagttactctaagaaaggttactgggattacatatttacatatttatacagtgttagtttccagaaatctgaaagttctattaaatctaataatgtaaaatataattaattcagtttttaattactctatcatgtaatcaggctgaaatctgatatctcagacaatcattccagaagtatatcttggcttaacaaatttctgtacctaattaatttgaggacccacataaagcaaggatttgagagaacacattttgtactgtacaactcagcacattttgtattacagtaactaaccagacctttgatttgtatgagtcatgtaaaaaataattcaaacagtttaaaatggtaaaaagaaaaacatcagtctttctttttatccttaatttcccaggcaaccactgatacctgggaagcttttccaaaacaaatttggatttctggtccctagctagacctgctaaaaaaaatcctctggggttagggtctggaatgctatcgaacaacaaaacaaaacaacacttgacctggtgctttctgaagttaacccacgtttggtatcactaaactaatctcacctttgccttcactttatttttcttttcttttcttttttttttttttttgagacggagtctggctctgttgcccaggctggagtgtagtggcgtgatctgagttcactgcaacccccgcccctagggttcaagtgattctcccatctcagcctcccaagaagctgggattacaggcacgtgccaccacgcctggctaatttttgtatttttagtagagacaggatttcgccatgttggccaggctggtctcaaactcctgacctcaagtgatctgcctgcctcagcctcccaaagtgctgggattacaggcatcagccaccacacctggcttcactttatttttctaacccaccttgttatctcttctctctaatatcttgttgagaaagcttttgatcattctgtcaaaaaaccgtaaatgggccaggcatggtggctcacgcctgtaatcccagcactttgggagaccaagtcgggtggatcactttaggtcaggagttcaagaccagcctgggcaacatggcaaaaccccatctctactaaaaatacaaaaattggccaggcgtggtggcgcttgcctgtaatacaagctcctcaggaggctgaggcaggagaactgcttgaactcgggaggtggaggttgcagtgagcaggagatcacgccattgcactccagcctgggcgacagagactccttctctaaaaacaaaacaaagactgtgaatgttccctgtgccagtttactaagctattatttttcagctccaagcgcacctctctcaattttgctttgtgacacaggattctgcttggactgtatctgctggatcggatggctctttgtcaggttctgtcagcagcgggctctaaagggagactagaagtctggaggaggaagggtcttgctcttcctttagagattcctgtttgcttgtggtccctgttccctgtggccatcactccaaaaatgtctttttttttttgagacagggtatcactctgttgcccaggctggagtacagtcacaatcacagctgactgcagcctcagcctaccgggctcaactgattctcccaccctggtatcctgagtagctgggactacaagcatgcgctgctacacctggctatttttaaaatttttttgtagagacggagtcttaactctattcctaggctggtttcaaactcctgtgaagcaatcctcctgcctcagcctcccaaagtgttgagaatacaggggtaagccaccatgcccggcccagcaatgcttctttacccaggaggaagtggcagtaagcagttgaagttttccaattcttgtataatcatgccacccctcctttgccatcacgagatgccaggaccacgcaagcagtgttccccttcagctcactggaggcctgagtttcagctacatggagctctttgtttaagttctaaattttaataattctaactatttccctttgttccctccacctaaggggtggtagctggctcatcaaatagctatctttgaaattttatgcccatgaagtagcataaaattgctacttcagtgttctttttcactttttaagttacacaagtgaacaattatttatattaaatcctctgttcgaatcattgaaaacattcagtctacagactgaattctctgatggtcacagtccccagttactggaaggtttggttcttttcagttattagatatgagagagtaaaatctattaattcctccaagggggtgggggtggggaacaaacccgatgatcaatctctagggacagagtattgtatcctgtccacaaccattaaaatcatataattaaaaatttctttattaacatgggaaaatatattcaagtgaaaaaggctaaaaaactgtatttatagaatgatcccaatgaggtgagaaatatttggaaggacaaatgccaaaatgctaatggtgtttatctctggtggtgggataattttattttcttcttcatggtcttacatatatttccccaattttctacaataattatttttagaaacaggaagaaaaaagttattttaaaaaatccagacaagaaaactggatataagtgggcattctattatcagccatttgttgtatggggatcacaaaaagatcactcactcaggatcgtcctgaaagtcttgaggttctgccaactcatcgtactctgctgctgcatccttgccagctaaaacgagctctttgggaggcaccaccacctggagagcaacacagagaggcctgcctgagaagggaccagtgtgacagaatatagcaaagtacgacattgatttagacaaatggaagcacacagcaagtttcaggaaacatatactacttctatggagtttataagaacaaaggttttaagagaaagctaagttagtacttacttcatggggtctgcaatgaggaactggggagaacatgggggcttcaattgtgtctttaatgttttattttattatttatttttttgagatggagtctcactctgtcgcccaggctagagtgcaaatggcatgatctcggctcactgcaacctctgcctcctgggttcaagcgattctcctgactcagcctcatgagtagctaggactacaggtgcccaccaccatgcctggctaattttttgcagttttagtagagacggggtttcaccatattggccaagctggtttcgaactcctgccctcatgatccacttgcctcggcctcccaaactgttgggattacaggcgtgagccaccgcgcctagccctaatgtttaatttcttaaggggatggggagaaatgggtacttgccatattattcctcatttttttttgatacatctgaaacagtccatcattaagaacaacacaaaggagaaacactggttccaacacaatgttttttgacatggtaccagctgattcctggtacctgatacataaacttacatgagatactgggtgattatggtcatggaaaacaattagcattcttcagacttatgttgtaattaggcctcaactttgctctatcagaggttaacagttaacagtgttgatcaaatttctaattatagatacaaatgtgggaggggaggtataaagagagctttataaagatatgctgtgcttatgcatcaggtacttatttctgtctgtcttaactggagctgcttattagtgttaataaaaaaaggaacgtcagggcacagtggctcagatctgtaatctcagcactttgggagcccgaggaaggtggatcacaaggtcaagcgattgagaccatcctggccaacagggtgaaaccccgtctctactaaaactgcaaaaaattagccgggcgtggtggcaggcgcctgtaatcccagctacttgggaggctgaggtaggggaatcgcttgaaactgggaggcggagagtgcagtgagccgagactgcgccactgcactccagcctggcgaccgagtgagattccgtctcaaaaaaaaaaaagcaacaaggaccaaataagtgaaataagtgttatctctctttggaggtgatgctagtaagtgaaatcattaaaaagcagaagaaaaaaaaaaagaggacagaaattctctaatattatttgaataagaactaaagatataggcatctttttaaaccatttctattataaatatcatgctgaattatgaattagtaatagatgatctatagagaaaggctcttgttctaaaatttcaagtactagaagtagcaaaatataaagagaggccatattacatccattcaactcacactgagtcaaaatcacctactttaacatttagttattttgttttttgagatggagtctcacctcagccgcccaggctggagtgcagtggcgcgatctcagctcactgcaatcactgtctcccgggttcaagtgattctcccatctcagcctccccagtagctgagattacaggcatctgccatcatgcccggctaatttttgtattttagtagagacgggtttcaccatgttggccaggctggtcttgaactcctgaccttagatgatccactcaccttggcctcccaaagtgctaggattacaggcgtgagccaccaagcccagactagttagtgctatgttatgtatactctttgtaaggtagaggaatctagaggaggcataccagcttctaaatgattttaaacgtatcatttctaaaaggaaatgatatttcacaagtgttgaagaatgaatgtatgagactgagagactgaaggggcatgtatgttaggggagtcaggataggaaggaggcatgctaagtaaaatgaatagcatacacaattctccagtgtcaaagtttataacccattggatctgtctggatcacaaccactaatatgtacgattcagggaatgctaaatttgaggatctgaaggaagaccacactggaagaacagagaagtaatgtcattaagcagctcttatgctatgccaaaaatctggacttcatctcagtcaagagcaatgctaaatgaccagcatgcacagagttagattttagaagtatcaccctggtggcaagagagaagaaatgggttgaaacagaggtggtggtataaaaatagcaaggtcatttaggaagttattgtcactgtccaggtaagaaacgatgagaccttcaaatagggcagtgtgtttcaggataaagtaaaaaaatttaggaggtggaatcaaaagaacttgctgactagatgtggaaaggagagtgtgtggagtcttttaagccaggtcaaatgaggacactccagggaaagtgcgggtcagtcaggctgaggcaaaatgctcctaccttagcagtgctgttgatatcatcagggtccccctcctcacactcgaagagagtcacatgggtgaggttctcaactggatttgtaagagtcaggaggacctggctctcctggtgaataggaaacacatctctcagacattcgccactttcttagctgctataccgaatatttcgcaaaattaccatccccgccattactcctgggcaatgacgccctacttatacctctacatcactgtattctctatgtgcttactgatccctgttctattatctatatgttagaccaaatactctctggagttgctatttcactgaggaaatgggacagattccactgaaagggccagttactagatccagaaattctgaggaatgttcattatctaagtgaagttaaaactcttgtctcacccaggctgccacttaaggactgaaaaggaggccctcataaataaaatatgggagccacaggccagtcagatgcatgaacagagcaaaaatggcacaccaagactacaaaaactttttaaaatttttattatttatttatttattttcgagacaaggtctcactctgttgcccaggctggagtgcagtggcatgatcatggctcactgcagcctcaacctcctgggctcaggtgatcctcccatctcagcctcctgagtagctgggaccacaggtgtgcgccaccacacctggcaaattttttgtattttttgtagagatggggtttccccatgttgcccaggctggtcttgacctcctgcacccaagcaatctacttatcttggcctcccaaagtgctgggattacaggtatgagccaccgtgcccgaccttataaaaactttttaagacttcttgaactgtgataatttgtccttgtttggtaccctctctagataagcaaaacaaatctttcaaatgaaggcccatgtaataaatatttgtgttttcaggagcagcatgaaagaagagttaaagagtttgctgcagaatattctacaattcactgggtgtgtgtgtggaaggaaggggagtagatgaggactccaaggaagagaagggctgtggtatataaatctaactgaatcctagtacctgaaacataacaaacaggagatcgaagagaatctctaggctggagaagaacaaaagatgcctgtgggatccaacattctctcctttcttttccccacctataatttcaccttaacataatgtgcaccctgctccttctccctacttttcatcagatgctgttgtcaagaatctcagtgtcaacaaatttagtctttattatcccaaactgtcttcttttctatcccttgctcactggatcctgtgccaaatacacacacagccacccacatacacatgtacacacatcattgatcaatcctttttcttcctgttaatgagcaaggtactaaccttcatgtagcgaaggttgggaattgacatgattctcacttctggaatataattgctgtgcataaataaaaaaatgcattaatgttcattggagtctcttaaaattattattattttttaaagctagtgcagtacataaaggatttcatgttaattagaatgtatcagaaaaaaaataattttaatgaaccatatcatcacagtaagaacttaagaaaagacataagaccaaactggtatgagttctttctgaaatcttacgtatatttctagttgaaactgcccaggccccagattagcatttacatatcaagatattgctttgtaatgactaaggcaagatatttatctccttgtgccttggttttcccaattctaaaatgaggaaaataatggtatctttcacttgaggttattgtgaagaatacatgcaagaatgctttgaaaagtgcttggaacaaagctcacataaatgttcattattgtgcatacattaacgtaatacgaaatctattgcagaaacattaaaagtgggggaaaaagtacatcttagaatcagatatttaaactttaaacgagctatttttcatggtgaccagcaggattacctgagtaacttaacaggaatttaagaaacttttgtcttcctgaatctcaaaaaaaacacacacacacacaaaagcaacaacaataaaaataaatttaaagaccccacttctaagaatttgaattcagtaggtctgaggtttgataccagagctctgtatttttttttttttttttgagacagggtcttgctgtcacccaggctggagtgtaacggcacaatcatgactcactgaagcctcgaccccccaggctcaagtgacattcccacctcagcctcccaagtagctgggagtacaggtgtgtgccaccatgctcagctaatttttgattttttgtacagatgaggactcactgtgttgcccaggctgggcttgaactcctaaggctcaagcgatcctcctgccttggcctccccaaatgttgagattacaggcatgagccaaacacctggcctcagagcatctgtattaagatagccaggcaattctaaaatgatgtcagaaaaaaatcactttttctcaaagcaagcttaagaaattgatgctaagtacaggctgccattcagggtttctgtaatgagtataattcttaagaaaggagttcatcccagacttcacaagtgccatttctgtaggtctctaaccaatcatgtattaagagtagttaggaaaatgaacatattttatggtgagttacaaggcatttgcaaacataattactcatttgattcttttcaagaatcccaagaggaatacattattcccatttcagagacgagggaagtatgtttagacaaaaatagtaagtgacagaccctcttcctggccctcctagctcctcctaactcactagacatgcacttcccaacctttttgtttcctaatacttatttttaattgctgcataatattctacagtacaagttatctcaatttaaccaactatttccttgttaatggttaatcagtttgacactgattaacttttggttaaactgtttgcagctttttgccattaatatattctaaaacacacctttggaaatgcatctttatatattggtgattttgtttctacagaatatatccctgaaacagtactgttgggttaaaaggtctatgtaatttgttttgatatttccagaccactctccaaaaagactagcaattcaagatcccaccaacaatgtgtgcaagtatgtgtttacccacattctcatgagcactagatgctaattaccttttaaaacttttcctatcaaatcttagtttctttccatatacagtgtatcttctggtcatttgaaattcctttcccataagctacctgttcaaatcccttgttccacattccactttactgcctccctctatttttatcttttcaatttctgggaattctctatgcctgggatattaaacttttgtttgtcatgactgccaaatattctttcttgctttactatttgtctcaggactttgttgctaattttgtcttaaaaaaatttttttttccttagagagagagtcctgctccactgtctaggatggagtgctgtgggacaatcatagcttactgcagccttgacttcctgggctcaaggggtcctctcacctcagactcccaagtagctaggactacaggtgcatgccactacacctggctaattttaaaaattttttgtagagatggggtcttactatgttgtccaggctggtcttcaactcatgggctcaagtgatcctcctgactcaggcttccgaagtgctgggatcacaagtgtgagccactgcacctggctttaatttcatcttttataaccactatttctttttgctaaggtcaaaggtgtttcttttcttttaatggcttctgggtttcctgtcttgctaaagaagggctctcttactccaaagctagacaatactttcctaatttgtgaaaatatttttgtttgccaggtaatttaaaaaatttatgtattagaaaagtatgatgagatatgaaaagtttacatttaattagatgaacactgggtaagttttaagtggcagtatttgtctctaattaggaccattcagatagcctgataggtagtttttatacacaaaattctcttctactcacaagtcccagagagttaacactaacttaatcactttcattccagtcaacgaagtgttataacacaggtaagtaaaatgaacactgttacagggatactcttcaatcagctatacttcattatttttaaattttttttgaaggattattcccaaactcagatactttataatttgtaatgatgactagtgactttccaccaaataatcaacataccttgttgctccagatcatactgggacactgtgtccctgatcccaatacccctgaatctatttatcttaaacttcatggcatgtaactaaattaaaaacctaaacaggaacagaatgtcaagattattttgatgtaatttttttttttttaggccaagagtaaacacacttcatactggggaagaagaataaaccaaaataactcaaaacagtaactgaaaacaccaatcccaaaatacttacacagcgaccagctggattttgaatttgattgacgttgggttaaattctggcttgctcaaattatgttcacatttctaaaaagaaaacaaatataacacgtatcagaagacaacaacacactttgttgatccatagagctgctaaattcagaaggacagcatttacgagaattttgttttgttttgttctgctataagaccatatgtttttgaataatgtatagcagccaaagtttataaaagatgttcgcacttcctgatatgtgcaaccccactatccaatattattatacctctgtggtacttaaaaactactaaaataacacatactgagtacatactgtatttgctaaacaacgtgctcactggtttaactggatttaaatatcacatcaactttatgagctaggtataggtattacattaaggttgccatattatagatgatcaaaatggtatacaggaagggtaagtaacctgtccaacttcacagagccaataaaaatggacactgggatttaaatctaggtagtaaaattccagatcctatgctttaaagtacagtaacaatgattacttttgagatagggtatcactctgttacccaggctggagtgcagtggcacaatcaaagctcactacagcctccaactcctgggctcaagtaatcttcctgccttggcctcccaaagtgctgggattacaggcatgagccactgcactaggacagtaataattatttactactttcttaaatacatactacatatacctggttaaaaatttttttaacagaacaaaaaaggtgtccagtgtaaagattacccattatctgtctgtccccttgttttctccagatagcctatgcacataaaagtacaagcatacatcaccttgcttttttcacaataacacaaaagggaacattttatatttattctcttgcttttttcatttattctatcttggaattaattccatttcagtacatatagagaggcctctgtgtcccactgtaacaatttctataacttacataagatagaaattgatggacattcaggatgtttccattattttgctactgtaagtaatgcagcgatgagtgttcttgtacatgaatcatttcctaagtgtctaagtatctgtaagacaatttcctaagagtagatcaaagggtgtatgcatttgctattttaatggatactgaaatataactgactaatctgacgattatgaaatgatattccactgcagttaattttttttaatttttcattttctcattgcagttttaatgtacatttccctgattagtgtataaatttgaatatctttcatatttattggctattgggatttcctctgccataacttgaatgttaggatctactggttatttttatttccttgccgatttgctgatattaacaatagattttaatctcttgttaataatataccttgcaaactacttttctcagtctgtggcttatcttttcatttctttatgggttttctttggcatgagggtacaagttttacttttaatgaagtaaaatatgtaactttacattacagtttgtgcttatttgtattacttatgaaacatttccctacccagaagtcatgaaggtattctcctctatttccttctagaagtttggctcttcagatttccaatgttcctgaaattaacttctatgtagggtgaggtagcaacccaattttattttcttccatataatcacttgacctagcaaaatataattgcctattctttccccaatgatctacaatgccatatttagtatataacaaattttctcatatgcatgggtctacgtctgcatacatatagacacacttttttttgtttatatgtacatttgtactttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaagcatcatttttacatgaaaagttgtctgtcatttgaaattatgcaaatgatgtcttgacctgaagcacaaaccccaggtacttaatgtttttaataatatggtgccactgcaggggttaggggcggtggggaagaacaaggataatggcggggaggattggcctaactaaccactaagtgaattgtactgcagctttgatttatgagacatccttatctgggatatttgagggcagctgcaaactaaaaacaatccagtaaatgtactttgtttatattttgtatcaggcaattatcaactgctaaataatagctttcatatttgcaactgttgcatacagagtacttttgctaaaaggtgattagctcttgcctttaattttacagtgcttaatgtgataaacttccagacatgtttcctataaaagagaccatttaatatatgtatataaaccacagtaatagtataacatactattttaaaattatttttttctacttaaaatatttaattttaggcttcttaggacatttctaaagcagattaaacccaataagcaggccgggcgcggtggctcacgcctgtaatcccagcattttgggaggccgaggcgggcggatcacgaggtcagaagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaacaaaaaacccaataagcttcctgatgatttttttgtaattggagatagttttctcaactgaaataacatttcagctaaataaagcattttaaaatattgatatttgataaaaaattgccttgtataatttctgtaaattatatttgttctgaaaaaggtataatgccctaatgttaaaagattttaaacaaatccttatcctttgatttttaaaactctgatctaatgataaaattctataaattttcattttcccgtgcagttaggtagcaaaatagctggtaattcataacttttacctattaaaatataaacacacaacaagcaaatgtatttaagagtactaaatggaaataaagtgttcaaaagagaaagtcttgtgttattgagcatcttagcctatttattattataaagtataaatgtgacttaaatcttttcttgttaataaaaactttcttttaactgaaaaagaatttcatcttctgaaaaatgttcagacttactttataataatccagtatataatcaacctttataagtgttctgtgtgtacttgaaaagaatgcatatattctgcagacattgggtacagtagtctatatatgcccatttggtcaagtttgctagataaattgtccaaatgttctatattcttactgattttcatctatttgttctctcggttactgagagaagtatgtcaaaatttcccaaaatgatttgtccatttatgtaattttctcaaatgtcgctttatatattttgagtctattattcagtgcacatgactttagacggttatatcttctttgtaaattgaatcttttttttaaacaaattatccctcttttaaaaaaattagtgtttgtccaatatttttcccacttctctctactttcaacttttctgagttctcatgtttgtgcttcttgtaataagcatatagatggatcactgcaatttgctttattatttagactgacaatgtttgtcttttaatggaagcatttagttcattggtatttaatgtaaatactgatacatctggattttaatctactatcttaccacacacaatcttttttttttttttaacagacagggtcttgcttcgtcacccaggctggagtgcagtggtgtgattactgctcacagcagcctcaacttcctgggctcaagcaattctcctgcctcagcctcctgacttgctgggactacaagtgtgtgaaccaccacactggcttttttttttttttttttttttttttttttttggtagagacagggtctcactatgttgcctaggctgatctcaaactcctgggctcaagtgatcttcctgccttggcctctcaaagtgttgtgattacaggcatgagcccaggctttctatttgaactaccaattcaatgttcctttgccccttctttttctttctttttataaaggtttttcattatagaaattttctaacgtgtacaaaaatatagaatggtattacaaatctctaggtacccatcacccaacttcaacgattatcaacttcggaatatatatgcaggacttgaatctatgctctcaggttaaacaaacaaaaagaatcagcatcttgttatcaaaaattagcaacaatggccaatcttgtttcatttatactcttacccattcctcatccctcattattttgcaacaaatatcagagaccaagtcatttcctccataaatatttctgtatgtatctccaaaagataaagacattaaaaaacaaacaaacaaagtactatcattattcctaaaaaagaaaaaatactttttttttttttttaagagacagggtctttctgtgttgcctaggctggagtgcagtggctattcacaggcaccatcatcacacactacagtctcaaactcctcaggctcaagggattctcctgcctcagcttccagagtagctgggactacaagtgcatgtcactgtgccctgcccaatagttttttaatagcatcgaaaatgctaccagtgtttaaattttctcaaagatttcacaaatttttctttccttctttcctctttcccttcttccctcctcccctgggccctttctttctgttttgtttgaatccgaatctacgtaaactctatacattgtgtttggtaaacttttaagtctcttctaatctagagaatgattaagtaacattagccactagcgacatgtggttatttaaatgaaattaaagactgactcagtacctcagctgcactatcacatttcatgtgctcaagagccacatgtgcctagtggctatcatgcgggactgtacagacacagaatacttccatcaccatagaaagttctgttggatagtactcctctaaaaggtttcttttccattttgtttttacaatttatttattgaagaaactctgtcatttgttctgtagattaccagagcctggattttgctgatttttcttgctttcttttaaattgattattttttattggtcctccctgagcctgaacactagcctaaaagttcacactctttcactattcttttaggggttaaccctatgtacttaaccttcagatacttcattttctacatttgtaaaacaggtttaacagtagtacctacctcacagagttgtaagagctgtttatattgaaagcatttaaaatagtgcctggcaattagtatgttctctacaagtattttctgtatttaatacattccaaaggttttgacattagtcagacaccagccacatttatttttgctttcctcttgtacaaatggtcagtctacagaatggaatacttacacggcagcgcagggaccgtttgatcagaagatgtttgtggcgaggatagagctgtgaagcacagactggctggaagtcaggctgtaacagacgctgctgaagggttgttactagaaagaaaggcagaaaacaggcttagtttacagtgactttcaaaatcagacttttatgtaccagtaattacacgaagcattactgcctttacgaacagtgttgttcataaaaatgaaaatatagaaagttgacattttagatttcaaacaattacctctattacagctgttttattttctacatattgtttttactactaacagctattccattaaaaatctcaaatcactaggtacataaataacaaaaacagaattagatgtagactagaaacaaagtagaaaaacacagaaaattaccctctgttaaatttactggtcttgtataatagtcttcaggtagaggttccacttcatccacagcctgagctggctcaatctttatctctttctgatcctctccttctttaaggctgaaaaattaaaaaaacaaaacaaaacaaaacaaaagagtaatttctcacggatccacctgattatcctcagtctatgatatcaataattgaagtattcctctgtcatagaatatctgtatagcgtaggtcttttctaagtatgagaatcttcttttccattgacaactgtgtgtgtgtgtgtgttttaatctcatttatttgatattcattttgatacctgctgttctcctcaaagtcatttcatgtctaaacttacgaaagtccggcaagggtactgatggatgcaccagctcgtggtcgctgaagcctggttccaagaccatatttgtcctaaacaaagttcagaaattcctattagaaagtccacttttacacaccctatttatcaaaagaaagaattttgggtaggatagcatgagaagctcagggaaataagcaaaaaaaaagctaatctaaaggcttcttttaaagaaagcaatttgtagccccacatcattattctattcttaaaataataacagcactaaacatggagattgaaactatattaatacagtaaaaatgaaccaaatgtgagcttctgctagtaatctaaaagtatctaagctacggctcaggcaagaactatgtggagtgtctaagatacacaacagacgtcttcctggaacaccagtggtcatctgctaacttcttcagggtcagcaagaatcataaaggagaacttaccactacatgaatagtatgttgctgtagagccccaaaatagcagcaggttgcaacagagacaaaaaatgcagcataagatagaagcaaacgcatatagcaggcaggttatatgggaaaattggaagaataattcatttaattcaaattctacctctaaatataacacacattggtgcatatgctgactataccactggactattcagaaaaattcacttctttttgcaaatgtaggtgctttgcaagtgttaatgtttttaaattctaatctagattttttttgagacagagtctcactccgtcacccaggctggagtgcagtggcgctatcttggctcactgcaacctccgcctcctgggttcaagcgattctcatgcctcagcctcccaagtagctgagattataggcgtgcgccaccatgcccagctaattttttgtatttttagtagagacagggtttcgccatgttggccagactggtcttgaaatcctgacctcaagtgatccccccgcctcagcctcccaaagtgctgggattacaggcgtgagccactgcacccagcttaatctaggtatttttatatggactttaccaacccttagggtttcaatgacttaactaattttcatgtggatgcagtatgacaagttgcttaactaggtcccatttcctcaagcgtaaaatggggatatgatactccacaggatttttgtgaggattaagtaaagtaatacatgtaaagtgtttatttagcacagagcttgacacatcattgccattcaataaatgttatttattgaatgtcaatttgctgggccccaagcaagcacacagaaaacaaactgtactatgagagcaaataaaactcggggtaaaataacaaaaattccaaatcctaatttctttcttcttactagcagtacgtaaactggtagagaatgactctcataaataattcttatcaaaaattctacttgcatatattactatttaaccacacaagtgcactatgtaaaaagtcagtgtttttcatcttggagaaacaggggaggatgttaaaaaaattataactaaagctgagaaaccactactgccaggatgtcaaaggtgggctacaggggtaatatgactgaaatctaccatttgcccacctccttcttctcagactttctgtaatacacaaaagctgtacgtggaactctgcagtgcctacaaaattaacagcctttctggggaaataatcagaagataaaggggagtgatggagaaagaaacacaaatgtcctcaaaacacaaataactcaaacagaactaatgatatagcaaaagcctaactattggacttaaacgtctataatttgaagaatccctctctctgatatccaccattcaggaatctaggacaatggccattttctgaaatgatcactgttcttaggccttagaggtcttgcaaatcattttagtaccaaattctcaccgaaaaagccagaggcatatagtttctacgtcgtgccagtttcttgcgatctcgctcaaccttctctttctgagcaagctgctggtaatattcaatcaatttgttcatctgtaagaaaatcacagactcagtacacaaaaaagctaacagaaaacatatcaaattaatcaactacactgactagacacataatgaatagagaagacaaattattaagatgggcaagtttgccctttttcttctaagataatttttcttcgttatgtgatctgttttccgaagtgaaatggaaaactgaagttcaaggatgggaagaaatgggcaatgaagaggcttggaaattttttgctctctaacttcattacttatttcccctcacaactgctcttattttttttctgcatggccacaggaccacttatttctaagaacatagcattttatactgtattttattccccaactccatcacactttttaatttttaaaatacattttaattataaaagcaatacatattaatcataaaaagttcaaaccaggatgggcacagtggctcacgcctacaattccagcactttgggaggctgaagtgggtagatcacttggggccaggagttcaaaaccagcctggacaacagagtgagaccttgtctctataaaaaaatgcaaaaattagctgggcatggtggtgtatgcctatagtcccagctactcaagaggatgaggtggcaaaaaaaaaatggcagataggaggcaggactaacttgcagcttcccctcagacagacagaacaacatgtggagactcacactgtgaatttttattccaagaactactgcaggaacatactaggaaaactgaaagaattcacagaccctttaaaagaagtggcttgctgctgcaaaatccatgagacagcagaaaatctgtgagtgcccatgtgtaagagggggaaaatccaccttcaaacacacatcctcactggagaacctaaaaatccagatcatgggagaaaaatttaaccttacctagtgctgaaacaaaatttagagagccgagtgaaatataaaaatagaagaagcaacagcgggaagagccctgtaggcactcccggttcccagtgaagcccagggaagtcatttctgactttaatctcacaggggtccttggggagtgctgccagtggaactgaggaaggaccacttggagacagaaacttccaggtgaactttgtaataactttgacggagagcaaattttcctgggcacaatcaagatggggaaggcgtaaaggggaagtacagatatgagcacataagccacagcagtcgggaaggggcggagtccaaaaggctagcttgctttttcagcaagtaggcttgtagcctgggccaaaatcttggccctgcaaaccccatgctgttggtggggcatggtgggagtgagactggccttgctggctgcatgggagctgggtgaagcctgtcactgctggctttcccctacttccctggccaccagtatgacacagcagaggcagccataatccccctgggaacataactccattggcctgagaaccacacaactgtccttcacagcagctgcagcaaaccctgcccaaggagattctgagctcagatatgcccccacctgatggtctttctctacctgccctggtagcccaagacaaaagactgtaaactcttgggagctttatggccccactgatcacctgggaaacccaaatacttatccaggcaaccttagggcaagcttgtatccccaccacactactgcagctgatgctttcttgaaagcgccacctcctggctggaggccaaccaactcattatagcaactcataaaagaacaaccctgccctcaaaaggagaaaacaacagctaattccaccacctgtgacatcctggctaaccagaggtcctgagtctgtccacgtgacaattcactgctagcacaaccagcattaaagaaaactagcatacgaaaccaaactacaaccaaggaccctcacagagtccacttcactctcctgctatctccaccagagcaggtgctggtatccacaactgagagacctgaagacggactgcatcactggactctttgcagacactccccagtaccagctcggagactgatagctctggccgggtggctagacccagagcagcaataacaataattgcagtccagctctcaggaagccacagggggagagcaccacatcaaggaacaatgtcgtaggacaaaataatctgaacagtagccctcaagccccagatctttcctctgacatagtctacccaaatgagaaggaaccagaaaaacaattctggtaatatgacaaagcaaggttctttaacaccccaaaaagattacactagttcaccagcaatggatccaaaccaagaagaaaactctgaattgtcagaaaaaaaatttagaaggccaactattaagctactcaaaaagctactcaaaggggcaccagagaaaggtgaaaaccaacttaagggaattaaaaaaaaaaaaaaaaatacaggttatggacaaaaaaaatctccagagaaagacagcataaataataaacaatcacaatttttgaaatgacagacacacttagacaaggcttttgaattaacccaatctgacaaatacaaagaaaaaagaataataacaataataataaaaaataaagcctctaagaagtctgggattatattaagctaccaaaactaagaattggtgttcccaaggaagaagagaaatctaaaggtttggaaaacttacttgaggaaagaatagaagaaaacttccctggccttgctagagatctagacatccaaatacaagaagctcaaagaacacctgagaaattcatcgcaaaaagatcaccacctaggcacacagtcatcaggttatctaaagtcaagacaaaggaaagaatcttaagagttatgaggcaaaaacatcagataacctataaaggaaaacctatcaggttaacagcagatttcttggcgaaaccctacaagctagaagggactggggtcctatctttagcctccttaaacaaaacaattatcaaccaagaattctgtatccagcgaaactaagctttgtaaatgaatgaaggataaagtctttttcagacacacaaatgctgagagaatttgtcagtaccaagccagcactacaagaggtgctcaaaggagttctaaatcctgaaacaaaaccttgaaacacaccaaaatataacctccttaaagcataagtctcacagggcctataaaacaataacacaatgaaaaaaaaaatctaagtattcaggcaacaactagcacaatgaatagaatagtacctcacatctcaatactaatgttaaatgtaaatggcctaaatgctccacttaaaaaatacagaattacagaatggataacaatttaccaaccaagtatctgccgtcttcaagagactcacctaacacctaaggactcacataaacttatggtaaaggggtaaaaaaagatattccatgcaaatggacaccaaaagtgagcaggagtagctattcttatatcagacaaaacagactttaaagcaacaacagttaaaaaagacaaagtgggacattatataatgataaaaggactagtccaacaggaaatatcacaatcctaaatatatatgcacctaacactggagctccaaaatttataaaacaattactactacgcctaagaaatgagatacaaagcaacacaaaaatagtgggggacttcaacgctccaccaacagcactagacaggtcatcaagatagatggtcaacaaagaaacaatggacttacactataccctagaacaaatggacttaacagatatttacagatcattctacccaacaactgcagaagatacattctattcattagcacatagaatattctctaagatagaacatacgagaggccacaaaacacgtctcaatacatttaagaaaactgaaattatatgaagtactcgctcagacagcagtggaataaaatggaaaatcacctccaaaaggaactcttgaaacgatgcaaattgcatggaaattaaataatctccttctgaatgatcactgggtcaacaatgaaatcaggatggaaatttaaaaactctctgatctgcatgataatagtgagacacaacctatcaaaagctctgggatacagcaaaagcagtgctaagaagaaagttcatagcattaaatacctacatcaaaaagtctaaaagagtacaggagacaatctagggtcataccttaaagaaccagagaaacaagaacaaaccaaacccaaacctagcagaagaaaagaaataacaaagatgagagcagaactaaatgaaactgaaacaaaagagacaataaaaaagataaatgaaacgaaaagctggctctttgaaaagataaaccaaattgatagaatgtgagattaaccaagaaaagatgagagaagatccaaataagctcaattagaaatgaaatgggagatattacaactgataccacagaaacagaaaagatcattcagggctaccatgaacacctttatgcacacaaactggaaaacctagaggagatggataaattcctggaaatatacaaccctcctagattaaaccaggaagaaataggaactctgaacagaccagtaacaagcagtgagattgaaatggtaattaaaaaaaactgtccacaaaaaaaaagcctaggaccagatggattcacagctgatttctatcagacattcaaagaataatttttatgaatcctactgaaactattccaaaagataaagagggaatcctccctaaatcattctatgaatccagcatcgcccttataccgaaaccaggaagggacacaacaaaacaagaaaactacagacagatatccctgatgaacatggatgcaaaaatccttaacgaaatactagttaactggatccaacagcatatcataaagataatacaccatgatcaagtgggtttaataccagggatgcagggatggtttgaaatacccaagtcaataaatgtaatacaccacataaacagaattaaaaacaaaaatcacaggatcatctcaatagacagagaaatagcatttgacaaaatccagcatcctttatgagcaaaaccctcagcaaaatcagcatagaaggaacatgccttaagtaaaagccatctacgacaaacacagagccaacattatactgaacagggaaaagttgaaaacattccagctgagaactggaacaagacaaggatgcccacttttaccacttctattcaacacagtactggaagtcttagccagagcaatcagacaaggaaagaaataaagggcatccaaatcagtaaagaggaagtcaaactgttgctgtttgccaatgatatgatcgtatgcctagaaaaccctagagacttatccaaaaagctcctagatctgatcaatgaattcaataaaaggttgggcacagtggctcatgcctgtaacccgaacactttgggaggccgaggtggacagatcacttgaggtcaggagctcgagaccagcctggccaacatggtaaaaccccatctgcactaaaaatatgcgtggtagcgggcgcctgtaatcccagctactcaggaggctgaggtaagagaatcgctggaacttgagaggcagaagttgcagtgagctgagtttgcaccattgcactccagtctggctgacagagagagatttcatctcaaaaaaaaaaaaaaaagttttgaattcagtaaagtttcaggatatgaaatcaatgtacagaaatcagtagcactgctatacaccaacagtgaccaagctgagaataaaatcaagaactcaaccctgtttacaacagccgcaaaaaccccacccaaaaaacaaaaacaaaatgcttaggaatatacctagccaaggaggtgaaagacctctacaagaaaaactacaaaacactgttgaaagaaatcacagataacacaaacaaatggaaacatatcccatgctcatggctgggtagaataaatactgtgaaaatgaccatactgccaaagcaatctgcaaattcaatgcaattcccaccaaaataccatcatcattcttcacagaactagtaaaaacaatcctaaaattcacatggaaccaaaaaagagcctacatagccaaagcaagactaagcaaaaagaacaactctggaggcatcacattacttgacttcaaactatatataagactatagtcaccaacgcagcataatactggtataaaaataggcacacagatcaatgaaacagaatagagaacccagaaataaaccaaatacttatagccaactgatctttgacaaagcaaacaaaaacataaactggggaaaggacatcctattcaataaatggtgctgggataattggcaacctaaatgtagaagaatgaaactggatcctcatctctcaccttatacaaaaatcaactcaagatgtatcaaagacttaaatctaagacctgaaaccataaaaattctagaagataacatgagaaaaatccttctagacattggcttaggcaaagacttcattaccaagaacccaaaagcaaatgcaacaaaaacaaaaataaatggaacttaaactaaaaagcttctgcacagcaaatgaaataatcagcagactaaaaagacagcccatagagtgggagaaaatctttgcaaactatgcatccaacaaaggactaatatctcaagtctacaagacactcaaacaaatcagcaagaaaaaaaacaaataatcccattaaaaagtaggcagaggacatgaatagacatttctcaaagatacacaaatggccaacaaacatatttaaaaaaatggtcaacatcactaatgatcaaggaaatgaagatctaaaccactcctgcaagaatggccttaattaaaaaaaaaaaagtaatagatgctggcatggatctggtgaaaaggggacacttttacactgttggtgagaatgtaaactagtacaccactatggaaaacagtatggagattccttaaagaactaaaagtagatctaccgtttgatccaataatcctactactgggtatctactcaagaggaaaagaagtcattacatgaaaaagacacttgcctgcacgtttatagcagcacaattcacagccgcaaaaataggaaaccggtccaaatgcccatcaatcaatgagtggataaagaatatgtggtatgtatacaccatggaatactactcagccataaaaactagtgaaataatagcatttgcagcaacctggatagtgttggagaccattattctaagtgaagtaactcaggaatggaaaaccaaacatcatacattctcactcataagagggagctaagctatgaggatgcaaaggcataagaatgatacaatggactttgcggactcagggggaaagctgggaagggggtgaggataaaatactacacattaggtacagtgtacactgctcaggtgataggtacaccaaaatctcagaaatcaccactgaataatttatccatgtaagcaaacaccaggtgttccccaaaaacctatttttttttcttttaaatggctgaggtgggaggattgcttaagcctgggaggttgaggctgcagtgagctgtgatcatgcaactgcatgccagcctgggtgacagagtgagatcctgtctcaaaaaaaaaaaaaaaaaaaaagttcaaacactatacacatgaaaagaataaaaagcaaaacttctcttttatcccttctgcccaagttgacttttctactcattagaggtatcaactattactggtttagatatctttcttactcagagaaacaaatatattatattttgcatatattttaaaatacttgtgtgtagatgtatagctttgatgtgtataaaaatacatacttattcctggcctcaagcaatcctcctgccttagcttcctgagtaatggggattacaggcatgagccactgcgtttgtctctaccgcattctttttctttttttgagacacagccttgctctattgcctaggatggagcgtggtggtatgatcatagctcaatgcagactcgaaaacctaggctaaagcaatcctcccacctcagcctcctgagttgctgggactataggcatgcgccaccacactcagctgaatttttaatttttttgtagagatggggtttcactgtattgcccaggctggtcttgaacttctgggctcaagcaatcctcctgcctcagcctcccaaagtattgggattacaggcatgagccaccacacctggctgtttatgatatttctaagagtatctgagaacaaatggaaccttaactcactggtgggttgtgtgaagaaaaaacaaaaacttggttccttttcctgatgcacaattcaaatacagaactaaagctacacctaggattctccattatcttaagtcatttggaaaaaagtgacagtgtatttcaatgtcttacaatgagaagcactgtctatgtgcaaagacgtattatggacttataaacacagctcatatctacccataaaatgcaagatcttcagtcttttactcaattttttccgatttcatcctctctctcttatgaccctttacttacccgttgtgtgtgaggattttcaggttcctgccaaccgccactagctacaaaataaaagaatattaaacaagactttcataatgtgataattttattttcataaaacaagtcttctgtaggccataaaaagaaacttaaaacataagttatatagaccattctggtctatataactatagactataatgttcagaacaaaattttaagaaaacatctaatgatggtgataacaatcaccaatgcacagccactgtgccaggcacttgaaatgtattacatttccttttattctcataacaaccctctgaggtaaggactcttattagtctcattttatatatgaggaaactgaggctcagagatgttaaataacttgctcaaagtcacacggagagtaagtggtaaagccaggattcaaactcagtctgactccggagactttgctcttatctgtaacactgtgcattttctaagttctatgaccttggcttagagaagaatttcttacgtaagaagcacacagcataaatcacaaaggaaaagattattcaagaaaactgaaagtactgaaagtaaaactataatgaacacttttaacaaatggtgctgcaacaatggaatatccacacatcaaaaacaaaacaaaaacctcaaaaaccaaaaaccaaaaggacccttacttcaacaacatttacaaaatttaccttgaaaagagcaagacttaggaggagccaagatggccgaataggaacagctccggtctacagctcccagcgtgaccgacgcagaagacgggtgatttctgcatttccatctgaggtactgggttcatctcactagggagtgccagacagtgggtgcaggacagtgggtgcagcgcaccgtgcgccagccgaagcagggcaaggcattgcctcacttgggaagcgcaagggatcagggagttccctttcctggtcaaggaaaggggtgacagacggcacctggaaaatcgggccactcccacccgaatactgcgcttttccaacaggcttaggaaacggcgcaccaggagattatatcctgcacctggctcggagggtcctacgcccacggagtctcactgattgctagcacagcagtctgagataaaactgcaaggtggcagtgaggctgggggaggggcgcctgccattgcccaggcttgcttaggtaaaaaaaagcagccacagctcaaggaggcctgcctgcctctgtaggctccacctctcggggcagggcacagacaaacaaaaagacagcagtaacctctgcagacttaaatgtccctgtctgacagctttgagcagagcagtggttctcccagcacgcagctggagatctgagaacgggcagactgcctcctcaagtgggtccctgacctctgacccccgagcagcctaactgggaggcaccctccagtaggggcagactgacacctcacacggccgggtactcctctgagacaaaacttccagaggaacgatcagacagcagcattcgcgattcacgaaaatctgtggttctgcagacaccactgctgatacccaggcaaacggggactgaagtggacctctagcaaactccaacagacctgcagctgagggtcctgtctgttagaaggaaaactaacaaacagaaaggacatccacatctgtacatcaccatcatcaaagaccaaaagtagataaaatcacaaagatggggaaaaaacagagcagaaaaactggaaactctaaaaagcagagcacctctcctcctccaaaggaaagcagctcctcaccagcaacggaacaaagctggatggagaatgactttgacgagttgagagaagaaggcttcagacaatcaaactactccgagctacaggaggaaattcgaaccaaaggcaaagaagttgaaaacttcgaaaaaaatttagacgaatgtataactagaataaccaatacagagaagtgcttaaaggagctgatggagctgaaagccaaggctcgagaactacatgaagaatgcagaagcctcaggagtcgatgcgatcaactggaagaaagggtatcagtgacggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcaagaagagcaactccaagacacataattgtcagattcaccaaagttgaaatgaaagaaaaaacttaaagggcagccagagagaaaggtcaggttacccacaaagggaagcccatcagactaacagcggatctctcagcagaaactctacaagccagaagagagtgggggccaatattcaacattcttaaagacaagaattttcaacccagaatttcatatccagccaaactaagcttcataagtgaaggagaaataaaatactttacagacaagcaaatgatgagagattttgtcgccaccaggcctgccctaaaagagctcctgaaagaagcactaaacatggaaaggcacaaccggtaccagccgctgcaaaatcatgccaaaatgtaaagaccatcgagactaggaagaaactgcatcaactaacgagcaaaataaccagctaacatcatcatgacaggatcaaattcacacacaacaatattaactttaaatgttaatggactaaatgctccaattaaaagacacagactggcaaattggataaagagtcaagacccatcagtgtgctgtattcaggaaacccatctcacatgcagagacacacacaggctcaaaataaaaggatggaggaagatctaccaagcaaatggaaaacaaaaaaaggcaggggttgcaatcctagtctctgataaaacagactttaaaccaacaaggatcaaaagagacaaagaaggccattacataatggtaaagggatcaattcaacaagaagcgctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaaccagaccttatagacatctacagaactctccaccccaaatcaacagaatatacatttttttcagcaccacaccacacccattccaaaactgaccacatagttggaagtaaagctctcctcagcaaatgtaaaataacagaaattataacaaagcgtctctcagaccacagtgcaatcaaactagaactcaggattaagaaactcactcaaaaccgttcaactacatggaaactgaacaacctgctcctgaatgactgctgggtatataacaaaatgaaggcagaaataaagatgttctttgaaaccaacgagaacaaagacacaacataccagaatctctgggacacattcaaagcagtgtgtagagggaaatttatagcactaaatgcccacaagagaaaccaggaaagatccaaaattgacaccctaacatcacaattaaaagaactagaaaagcaagagcaaacacattcaaaagctagcaaaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatatactctcccaagactaaaccagcaagaagttgaatctctgaatagaccaataacaggctctgaaattgaggcaataatagcttaccaatcaaaaaaagtccaggaccagatggaatcatagccaaattctaccagacgtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatgcagcagcacatcaaaaagcttatccaacatgatcaagtgggcttcatccctgggatgcaaggctggttcaacatacgcaaatcaataaatgtaacccagcatataaacagagccaaagacaaaaaccacatgattatctcaatagatgcagaaaaggcctttgacaaaattcaacagcccttcatgctaaaaactctcaataaattcggtattgatgggacgtatctcaaaataataacagctatctatcacaaacccacagccaatatcatactgaatgggcaaaaactggaagcaatccctttgaaaactggcacaagacagggatgccctctctcaccactcctattcaacatagtgttgggagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcgaggagaactacaaaccactgctcaaggaaataaaagaggatacaaacaaatggaagaacattccatgctcatgggtaggaagaatcaatatcaagaaaatggccatactgcccaaggtaattgatagattcaatgccatccccatcaagctaccaatgactttcttcacagaattggaaaaaactactttaaagttcatatggaactaaaaaagagcccgcattgccaagtcaatcctaagccaaaagaacaaagctggaggcatcacactaactgacttcaaactatactacaaggctacagtaaccaaaacagcatggtactggtaccaaaacagagatgtagatcaatggaacagaacagagccctcagaaataatgccgcatatctacaactatctgatctttgacgaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaagatccagaatctacaatgaactcaaacaaatttacaagaaaaaaacaacctcatcaaaaagtgggcaaaggatatcaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaatactatttgacccagccatcccattactgggtatatacccaaagaactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccacaaaaaatgatgagttcatgtcctttgtagggacatggatgatattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataagaaaaaaaaagaaaaaaagaaaagagcaagacttaaatgtaagtgttaaaactacagcacttctagaagaaaacatgggtagatcttagtgacactgggttaggctaaagtttttttaataggacacaaaaaacacaaactataaaataaaaaaattggtaaattagacttcactgaaattagaaacttgagttcttcaacacacactgctgagaaaaggaaaaggcaaggcacagactgggagtaaatatttgcaaaacatatattcaacaatggacttgtatccagaatatagaactcttataactcagtttaaaaaaccaaatcaaaacaaaccaacaacaacaaaacccagttaaaaagtagggaaaagatttgtacagacagttcaccaaagatatatggctggtaaacaaacacaatgagaaaatgcaaattaaaaccacagtgaagtactgctgtacatgtgctagaatggctaaaatgggtaagactgacaatatggcaagggttgtcaagggattggaactctcctaatttgctggggaggatccaaaattgttcagtcactttggaaaacagttgggcattggccaggtgcagtggttcatgcttttaatcccagcactttgggaggctgaggcaggagaactgctagagtccaggagttggagaccagcctgggtaacatggagaaaccccatctctactttaaaaaataaaaaaaaataaaaatagtttggcagcttctagacaaattaaacatacacttatcctatgacctaataatttcactctttggcacttaagaaaaatgaaaacatatattcacacaaagagttataggcaaatgttcatagcacctttattcacataagccaaaacccaaaaacaatccaaatgttcaagtggagaatgaataaacaaacatgttcatacaacagaatactactcaacaataagaagaaataatataaagaagaaacacagatgaacctcaatagcattatgctaaataaaagaagacagacaggaaagactgtaatgtaagactccaattacatacacttctagaaaaggcaaaattctagtgatagaaagcatatcagtctagtcaggggccgggaggttgggggaagaaactgactgcaatggggcatgaggattctctagggggacagaaatgttgtgtatcatgattatggtggtggctatgtgattacacacttgtcaaacatcacagaattctacacttaaaattggtaagctttattatatataaattatatattggtaaagctagccaaataaagggaaaaataaaagtataatgagataccatttcacaaccatcagtctggaaaaattttagagtccaaaagtactaagagctgacaaggaactggagctacaggtagtttactcttacatattactactaggagcaaagactgctaaatcattttggagtgctaaggatgtacacaacttatgactggcaattttacttctagttatatagaaaagtccttacacttgtgccttaggaaacacatacaagattgcttccagcagctatattttttcaaaagcaaagaaaatgaaaacaacctaaatgttcattaagagaagacggaataagtaaactgtggtgagtcatacaggaatcaactgtgtatcagaaacataatgctgatagagtaaagttgtagcaggatatatacagtatgttttcatttgcttaaaagtgaaaaatgttatttgtttgtggctgcatacatatgtggagaagtataaagacatgtatggatgctaataaacactgaattcaggattgtgattattatctctagcgggcagagaggaagataaagtagggggagggcttaaactgttttggctgtttcatttcttaaactgggtgataagtacatgaatatacatatttcatataaaatcacttttttcaaaacaaaaaggacgcaattaccttgctgaaggtgacattgtatcctcttgcaagaaatggcagaaataacactttagtataatattattttagaagttgcctcacttaaggcaatcatgaaaaataattatgtgaaagaaatgtttcagctgtaatatttttaaacgtctgaatattttatctaattgcttcttttgaactggtaatttattctaagtagcaatttgggagacataataatctcattgtaagtttttctccgtacattacagacaagtacttataaataaacaaatagttctaacttaagtggtttcagggcttctgagataccaatgacatcaaggaggaaatgaaattatctgtacgctttaagagctcctggtattcaattatccctgttgagataccctagaggagatacagttctagaagccagcataagtttatagttctgaaatataaattctccaatcttcatgactcataaaccaaaaagcataaaacactcactaacagagtaacaaactgagaaatctacttggatttccgggctgtttcttttacttgataaaaagacacaaaatacaaacatgaaaaaacaatactttagttcactgaggcctacattatgccactttgaggttgctttttaacatttaacttactttctttaacttatctcctatactgacactaaaacatatacacataaatacttactggcaattttcaaagatgttacagaatctttctattttcagtcacacttcaggtaaatagctacccaccaatgagcatttttaaggaactaagatatacttatttaactttctgtttttgaaaagagtatgtattttatcaactcaatgtacaaagtcagaaaaaccatcaacagctcaaagcattctaaaccaaagagcaaattcaatagaatcaaggattaaatttttaagaacatagttgaatctaaagaacttcacccatatttacttccaaattgtgtaagaatctatagaaaggttttagccagtctgcttcattttagttatgtcaaatgacatataatgaatttgttatgagcttcctcatttattagtcaataagctgtactttttatgaaaatcccaaaatgagaatttttacaagtttaaaatgtttttagaaaattaaacaatgaaacctcagaaaaaaaaatacggagttagtgatgctactacttatataaagcataaatagcaactcaagattttattaattttttttaaactttggatcacttaaatcaaaagcaactcaagattttgaactgactgtacagagaatgtttccactctatgatgttaaccatgaaatacagaatttgcaaaaataaagtttcgtgataaaattaagtgtaatctgttctaaaacactcaaacactcaaatgatggaggtatataatgccttaggtggtcttaaatccaaacataccaatttttctctttcactgataaacattttatatatatacgtaaaagtttttgagcacatgtttgaatgctccaggacagacatttggacattgaattactgggcagaaggatataagcaatttaaaattttaataaatgttttaaaattggtctccaagatagactaccatagtgtatgagagaactattctcctatgttctagccaacacttgatacaaccagattaaacatgttgtaccaaatagaaggaagctttaatttgcatttacatgactactagggaagtcgaatacatctttttgcatattcattgaccatttttatttctactatgagaattgctgctcatatcctttgcctgtttttctactaagtctttttcttattgacttataagcgttcctcatttctgagtattcatctttagcctgttatataagacccaactatttttcttagtttgtcatttttatctttaaagattttttttttttttgagacagagtcttgctctgtcacccaggctggagtgcagaggcccgatctcggctcaccgcaagctctgcctcccaggttcacgccattctcctgcctcagcctcccgagtagctgggactacaggtgcccccaccacgcccagctaatttttgtattttttagtagagacggggtttcactgtgttagccaggatggtctcgatctcctgaccttgtgatctgcccgcctcaacctcccaaagtgctgggattacaggcgtgagccaccgtgcccggccttatcttttagttttatccatgatgtcttaacatgaatgtttatttttcatgaagagcattaatattttgattccaagaaagtaccagatttataaaagctattttatcaagtctaagaaaactaaatattatcccatctcagataaaacactaaggtctacaaatgtgaacatatgggaacacagaagagttaatgacaaaatattctgaatttagctcctatcgccccaacgggttacagaaataataatctatgggcaattatagcactgtcaattgtacaaaatttcatattgaagtccatctcactcacctacagatttgtctgccatgcccacatctctagacgtccagcgacaaaatccacatgccaggtaataggctttcttcatggtggtcttggctgggtcatctggaagctgtgtggagatgctcgtggcccgagtagagagggtgtgcatgcagccaggacagtcaaaacaattggcacatctgtgacatgacaaacacaaccattcattcaacaaatatttatcaaggaattcaagagagaacaaatataaggacaagtgtctctcaagaaaaaacagtaacattctgcaggcctcttaccaactttgctttaacagttcaagagtactatatgttcattagtttaaaaaatatgcagttatcgccaaagtaagaattagagcccaacccaatcctactccacagagagaaccattgttaacagatggagtttatgattccagactctttttatgcttatattgatcacaaagatttctgaggaagagaactgtcacagcttatgcctttagagaggacagaccaactgtgccatagaaaacttagagtcaacaatacaagaagctgtgaaactggatttggaaaataaccgactgctgtgccagagagcttcaacagaaagcaaacaatgctatcaaactggaatggttcagaagcagcatattttcagggctttctgttctctccttaaatgctacttttcctagtgctcagccaacatttctcctttaggaggtccctatgtcttcttgcttttaactctcccaccagcacagattatcaagatttcacctgcagtcctgtacctgcttgaagttctgttctataatataacttgcattatctgttatagtctgccatctggatactatcaaaagaagataataatagtactcaccttacaaggaagctttgaggattaaatgataaaaattaatttgtggaaagtatacaaaacagtatctggttatcaggggttacttctcagggcaggaaagacaaataatagtggttcacatccataaaggtatgggggtatgactaacagcaaaaggactttcacttcaagctaaaaactaaacaccatccagtagcaatgagcaagcctagcagccatatcttggtttctaagactattctccaataaagtgaaccaaggctccttggagaaacaactctaagactgagacagaaaatatacaagatgaggctgggcacagcagctcacgcttgtaatcccagcactttgggccaaggcaggtgaagtgcttgagccaggagttcaagaccagcctgggcaacatggcaaaagcctatctctccaaaaaaatacaaaaattatccaggtgtggtagcatgtgcctagtctcagctactcaggaggctgaggtggaaggactgcttgagcctgggaggttgaggttgcagtgagccaagattgcaccactgcacttcaacctaggcgccaaagtgagaccctgtctcaaaaaaaaaaaaatacacacaaaacatacacacaagatgagtctggagtatcttgtagtactggtaagaaaatgatcaaagtaatgaacagagaactctctcctgctcctaatgatgggggtatgtcaaagggatctaggagtcaactgaaagagctcccaatggccaaagctgaaataatttgagcaaaataaataaagtagtattggattacaagccaaaatataaaatgaatattcataatcccactgtcctataagtaagtgatttaaaaaacaaataaacaagaggagaagagacagatcttccatgcaaaagaattccaaatccaaataatttatgcagatagtcctcaaggacaggggagcataattctctagtctttatgggctgtgacagtaattttccttccaaaaagtagagtacaaaaaaagaaggaaaagcagtaactttacagtggagaaacctgacaaacactagctcaagccagataatcaaggttaacaccaacagtgacaagtcataagtatttacccttgatatgatgtaatcaaagatggcactttacctctgtggttctcctccgcaaaatacattcccctagtctgatgagaaaaaaacatcatgcaaatcctaatgaaatgacattctataaaatacctcaccagtactcctcaatacttttgaggtcatcaaaaccaaggaaattttaagattctcctatcacaccacacccaagaggagtctagagacataactataaatataatgtgatatcctgaaaagaatcctggaaaaaaaggagaccacagaaaaactaaggaaatctgaataaaatgtagtgtattggttcattaattgtaacaaatataccacactaatgtaaaaagttaacaataggggagactggatgtgaggtaaatgggaactctccatactatcttcaccataattctgaagtacaaaactgttctaaagtagaaaatctatttcaaaaatcaaaggggatttcatctttggcaatggtgatgcttaaaaatgaaaaagagctggttaaaaaagttaatttcatgtgtcttttttttttttttttttttgagacaaagacttgctctgttgcccaggctggagtgcagtggcacaatcttggctcactgcaatgtctgcctcccaggttcaagcaattcatctgcctcagcctcccaagtagctgggactacaggcgcgtgccaccacacctagctaattttttgtatttttagtagagatggggtttcgccatgttagccaggatggtatcaacctcttgacctcgtgatccctgcctccgcctcccaaagtgctgggattacaggcgtgagccaccatgcctggcccatgtgtctttttaactagctattttagagaacagtcaaggaaaataggaagaaaaaaaaaatcagtccaggtcttacctattcttttttagtttggcttcagccgatggcatattttctaaacaactgggacaataatgggagtccacctaggaggaaacaagaaagaaaaaaaaaaccagaggagaactcagtttaacttgtgtatatgtcttgtcaaatagtgaattttaaaatatgttatactgtagcagaaagtagactgttttctgcttagggtttattcttcttcagtcacctgttttttttttttcttcttcttccggatttaaaaaatccttctatttttctgatctttcctattccatcatcagggttttatgtgttaaaagttgtttatttaacaatctacaatttccagttgaactccatagaattctatgattaataaagagattaataaaataatccaatttgtaacattgtgataaaatatcctcctgtctaggctagctttatatgactataaaacttgaccatacttttaggttttgaaggacatttttttaaagatttctcattattgaagtaatacaggttgactgaaggcaagcataaatatttatttacatagtcagctatggccaaccaattagagatttttaaacaaattaatgggacagtcttattgtacttaaaaaactggagtctaaaatttaagttcattttattttttaaaagtctgaataattattttctttaatgtaggtcctatttgacaattatagaactctagtcacctgcaaatgaaaagacaatcactggaacataaatactatgatagaaactggcttttttcatcatctgctataaacaggtcaatttgaaaagattaataaagttgttgctcaaataatctccaggaacataaaatacaatattgctaactaacctctgcactgactcatcaaaaaaggcaaaatacaagtcattcctttttgccccctttccaaattctgcttgtccgttcatgtgcagctccagacccagattctccattagaacttcactgcctgccccagccctcagagcttcatctttccctaaactctaatggcctccatatcacaggtacacatcaggctgtaaaagatgctgtcacagactggatgtcctaattgaagagagtcttagagacagatcatggagactgagcactctattcaccacaggagaatatgatccaataaattctggaggtggagctggaatagggaatcatcaaggagatacacataaggaaagtgctaatggagatgagaagaaaaatcgatgccatatttttaatatatacgatttttcttgtattatttaattgcttttcttgactattcctattatgaaaagtatcttcaataaaataagttattaataacacataaaatggcttatagtatgtgttttcatatgcatttattttaacagtcccgggatcttcagtaaaaaacactctgagttaggctgtttagattcaaatccaggtcctccttcccacccccaaattactggctgtgtgacttacagcgaacactctgtatctgtttctttacctgtaaaaaaaattttttaaaaaaagtatccacttaaattggtttgaagattacataaagcacatgacatatagcaagtatcgaataagcagcaactattactactatcagctttttcttcactaagactatggcttattaaacagcgcattttatgtcttactcgccttttaatccctaaagcttactgaataaacaagatgtgccaagcgctgcagaagttttggggttttgttatttggtgactttttactggccggggtcttctttttgaaaaatccaacttcggacgcccacttgtgccagggaaggacagcattgtcctctagctccataaatacactttcagcttcttacatgacatactgtattctgagcgcttttcacataactcacgccgccccaacctcttcccggctgcaggccttggcctgagtcaggaacagggcaaggcagtctgacgagggcccagtttctggacaaaagaggaacagaactttcaggatgggagaactatgaatgagaacgcctgcgcctccctccatcctcgcaataaatcctggaaaggcagtttttcgccccttaagtggcctgaactaagcacccccagacctttctccgtagtccacccaattaccaagccccatcgcagacagacacggtccctaagtcaagtttgtccaatcagaggccgctctagaaccagaagatccgctcagtcccacccgaggctgctcctcctttccaagtgacagattagaagcaaattaaatcgcaggcaaacccgagtgacggaagacataaccaatcagtaaggaaggaaaatagctccagccttccggtggcagtgactagcatgaacgccgcgccccccccaccccacatactcgctatagggcgactctgttacctcgtgagacacacattccagcgaccgcagttcgctacaatagcggcagaagtagagttgcgagagcggggcccgaaccttcttttctccctggactagatagagaacccggtccgactgcagcaaggacgccatcttggggagggaggaggcgatgacgctcccggcgcatcacgtgacccgagagccagcgtcttcctcgctgccttccctacgacttcctacgtagactttgac

SEQ ID NO: 2252 - DNA, 49775 bp, Homo sapiens
ctcaagctttgtctgctttatttcactacattaagttaagcaataaggcaaaacagtaacctgtcattcataaagatcaaggagtacctctctgtcccaaaagggaccaaaaagggtgtttcttcacaaatatgcatgacacttagctcattatgctgataagcacttcaaacaaaagaaaaggtcagtaggtgaatcaagtaacaaatccaaattaacttagcctaagtttccaaagctgtagtttcaagtgctaatgggatctaactttcctgtggtggtgcatactgactagcattaaaatttttgcacctcatctaatataaaaaaggcaacaaatacaattcctaattcaccagctgcaggtattgaatcatttctacgaacacacagaatactagcttacactaaaacctatcttgaggaaacattaaaccagtggctctattattctgcaagttagtttggcttctgaagaaaaaagtttatgatcaaagtgttttgtgtttctgtgtatgggaatgatgagacccatacttcaacattattactttggggaataaataccagctacctgccataaacgcatgacatgtgtgtagtctatgcaaacgtgtaaacatatgaagctattctctactctatgcccatttcctccactggcaaatatggagcagtgatttcacagtaggctctagcaggtagtgaaataaaaatttgagactctgtggggtcacaaaaaaatgaaactctttctatagtctgcaaatctgtaattacccatccccctgctccaactcctaagaggctaaatgttattaccataatgttagagatgagtattttccttcttacactgcatcacatatattactctgtaggactgtttcataaaattggcttgacctttgtacaattagtacaatttagtgtcttttagagtacaatttagtgtcttttaaaagcttcctaaatatttaaaacattttcaagggaagcttacaaggactatgtcccatctgtattctacattataatgttatctttaattttttaagacttaaaacaagaccaaggtaaacaaaaaatctgtattttcctcaagtctcttggccacttactaacaatacttttacagaaaacacggtgcagctggtggtctactttatcaagtttcattttagaaaacatcatagaaattaaggttagcaacccaactccaggataccaagtgaaaacagcaagtctgctgttaggccagaactgtgggctacttgctgaactattttatggtttacaatcaaaatggtcttatttgactcaccacatgacaaaagtcttaaacttagtaagggggaaagttcttaatatccagttttggattcaagagattataatagttaatttccccttcaaatcaatggaaagaatgctagttgagaatattctaaaaatctagcctttaaaatgttttctgcattccagaaatgaacctgtccactcaggttttctttgggttcttttccaggtcccaaacagaacaacttaactgagttaaagaggcagaacagggaaggggtaggaagtaagacaaataaagattgcccccctgtggcagcattaatccctgggtattgtggcaatattgaaaacgaatggaatctgctacccccttgacatgacatgtaattgtttgcttctcaaattcttcttaaaagatccatattttactgggaaaaaaattaagaacaactaatacgtgtcctgtattcacttagaaaaagagggcaaatgagagtgccttaacaacttcacaggtttttccaatcatcatgatactaaagataaagtgacaattcagtttttcagttatatggaaatctatggcaaaatggcagccattatggcaatgaagggatatgttttagactgttagatgatatttaacggaatgcagaaagcagttggtacattgtgaccaatgctggatcattaacagcaggtctacctttgggttatcatttaagtttcatctgtgacattgtgatccttagtgagatcagatcaagagacagtacagagtttctcaggtggtaaatacaatgccattccaaggaacacccatcccctttcctaggatggaattatgctgctgttactcaacgtgcagggttcagtgagggagacacagacttactggtgtcaacaggggtgagagcaagagcaacagcagctaccctgtgttcccaatgccttgcctatgctcccactttcttagcaatagaattccgtagtgcatgggtacatcgttataaacaaggcctaatgaagcagcagcttccacattttaacgcaggtttacggtgatactgtcctttgggatctgccctccagtggaaccttttaaggaagaagtgggcccaagctaagttccacatgctgggtgagccagatgacttctgttccctggtcactttcttcaatggggcgaatgggggctgccaggtttttaaaatcatgcttcatcttgaagcacacggtcacttcaccctcctcacgctgtggtgtaactttgatgaaaatacccactttgttggcctttctgaaggctataatgctatggaaagaaaaaaaagcaagtattaggtagataaaaaaatcagccaaaccactaagacttacagtaaaagtctttcaccttattctttccttcagcacacacagaaaacctataaacactttgttcttaacctaccaagtatttttttgttttgttttgagacacagtctcgctctgtcgcccaggctggagtgcaatggctccaccttgggtcactgcaacctctgtttcacgggctcaagtaactctcccatctcagcctcccgagtagctgggactacaggcatgcaccaccacacctggctagctttatatattaatacgtatattttttggtggagatggggtttcgccacgttgcccaggctggtctcgaacaccagggctcaggtgatctgcttgccttggcctccaaaagtgctgggattacgggcataagccaacacgttggccatatatttttctatgagcttatacttttctgcttttctaaccaacacagatggtacacactattccataacttgcttttttttaactctgtttatcacaaacaccttttgacgctggtatatacagatcatctacaatctatgtaatggttgcacagtattcaattatgtgtttaccataattggcatatactgaggttgctgacaacttttctctattataaacaatggtgctgcaaacatccctttacatttacctctgtgcaaatgcaatatttctatagaacatagactcataccgtggaaagttatttatttatttatttttttgagatggagtctcgctctgtcacccaggctggagtgcagtggcgcaatcttggctcaccgcaacctccgcctcctgggttccagcgattctcctgcctcggcctcctgagtagctgggattacaggtgcacaccatcacgcccagctaatttttataattttagtagagatggggtttcaccacattggtcagactggtctcgaactcctgatctcaggtgatccacccgcctcagcctcccaaagtgctgggatcacaagcataagccaatgcacccggccttatttttattttttagagacaaggttttgctctgttacccaggctggagagcagtggcacgatcatagttcatggtagccttgacctcctaagctcaaatgatccttctgccttggcctcccaaagtgctgggattataggcatgagccaccatgcctggccatactgtgggaagttttaataactcagtgctttaagggaaattttggaacaccataaatcaagaatgtttttgtaaataacttatgtaattaggaattttagcacaaaaatgtctcttcattgaggtttgcatttcaatttcccctcatttgtgcatacagtttgtgctttaataacttagtttctgaaagtaaaagggcaatgaaataaacagaatttgtctactacccaaatgacattcagttactctaagaaaggttactgggattacatatttacatatttatacagtgttagtttccagaaatctgaaagttctattaaatctaataatgtaaaatataattaattcagtttttaattactctatcatgtaatcaggctgaaatctgatatctcagacaatcattccagaagtatatcttggcttaacaaatttctgtacctaattaatttgaggacccacataaagcaaggatttgagagaacacattttgtactgtacaactcagcacattttgtattacagtaactaaccagacctttgatttgtatgagtcatgtaaaaaataattcaaacagtttaaaatggtaaaaagaaaaacatcagtctttctttttatccttaatttcccaggcaaccactgatacctgggaagcttttccaaaacaaatttggatttctggtccctagctagacctgctaaaaaaaatcctctggggttagggtctggaatgctatcgaacaacaaaacaaaacaacacttgacctggtgctttctgaagttaacccacgtttggtatcactaaactaatctcacctttgccttcactttatttttcttttcttttcttttttttttttttttgagacggagtctggctctgttgcccaggctggagtgtagtggcgtgatctgagttcactgcaacccccgcccctagggttcaagtgattctcccatctcagcctcccaagaagctgggattacaggcacgtgccaccacgcctggctaatttttgtatttttagtagagacaggatttcgccatgttggccaggctggtctcaaactcctgacctcaagtgatctgcctgcctcagcctcccaaagtgctgggattacaggcatcagccaccacacctggcttcactttatttttctaacccaccttgttatctcttctctctaatatcttgttgagaaagcttttgatcattctgtcaaaaaaccgtaaatgggccaggcatggtggctcacgcctgtaatcccagcactttgggagaccaagtcgggtggatcactttaggtcaggagttcaagaccagcctgggcaacatggcaaaaccccatctctactaaaaatacaaaaattggccaggcgtggtggcgcttgcctgtaatacaagctcctcaggaggctgaggcaggagaactgcttgaactcgggaggtggaggttgcagtgagcaggagatcacgccattgcactccagcctgggcgacagagactccttctctaaaaacaaaacaaagactgtgaatgttccctgtgccagtttactaagctattatttttcagctccaagcgcacctctctcaattttgctttgtgacacaggattctgcttggactgtatctgctggatcggatggctctttgtcaggttctgtcagcagcgggctctaaagggagactagaagtctggaggaggaagggtcttgctcttcctttagagattcctgtttgcttgtggtccctgttccctgtggccatcactccaaaaatgtctttttttttttgagacagggtatcactctgttgcccaggctggagtacagtcacaatcacagctgactgcagcctcagcctaccgggctcaactgattctcccaccctggtatcctgagtagctgggactacaagcatgcgctgctacacctggctatttttaaaatttttttgtagagacggagtcttaactctattcctaggctggtttcaaactcctgtgaagcaatcctcctgcctcagcctcccaaagtgttgagaatacaggggtaagccaccatgcccggcccagcaatgcttctttacccaggaggaagtggcagtaagcagttgaagttttccaattcttgtataatcatgccacccctcctttgccatcacgagatgccaggaccacgcaagcagtgttccccttcagctcactggaggcctgagtttcagctacatggagctctttgtttaagttctaaattttaataattctaactatttccctttgttccctccacctaaggggtggtagctggctcatcaaatagctatctttgaaattttatgcccatgaagtagcataaaattgctacttcagtgttctttttcactttttaagttacacaagtgaacaattatttatattaaatcctctgttcgaatcattgaaaacattcagtctacagactgaattctctgatggtcacagtccccagttactggaaggtttggttcttttcagttattagatatgagagagtaaaatctattaattcctccaagggggtgggggtggggaacaaacccgatgatcaatctctagggacagagtattgtatcctgtccacaaccattaaaatcatataattaaaaatttctttattaacatgggaaaatatattcaagtgaaaaaggctaaaaaactgtatttatagaatgatcccaatgaggtgagaaatatttggaaggacaaatgccaaaatgctaatggtgtttatctctggtggtgggataattttattttcttcttcatggtcttacatatatttccccaattttctacaataattatttttagaaacaggaagaaaaaagttattttaaaaaatccagacaagaaaactggatataagtgggcattctattatcagccatttgttgtatggggatcacaaaaagatcactcactcaggatcgtcctgaaagtcttgaggttctgccaactcatcgtactctgctgctgcatccttgccagctaaaacgagctctttgggaggcaccaccacctggagagcaacacagagaggcctgcctgagaagggaccagtgtgacagaatatagcaaagtacgacattgatttagacaaatggaagcacacagcaagtttcaggaaacatatactacttctatggagtttataagaacaaaggttttaagagaaagctaagttagtacttacttcatggggtctgcaatgaggaactggggagaacatgggggcttcaattgtgtctttaatgttttattttattatttatttttttgagatggagtctcactctgtcgcccaggctagagtgcaaatggcatgatctcggctcactgcaacctctgcctcctgggttcaagcgattctcctgactcagcctcatgagtagctaggactacaggtgcccaccaccatgcctggctaattttttgcagttttagtagagacggggtttcaccatattggccaagctggtttcgaactcctgccctcatgatccacttgcctcggcctcccaaactgttgggattacaggcgtgagccaccgcgcctagccctaatgtttaatttcttaaggggatggggagaaatgggtacttgccatattattcctcatttttttttgatacatctgaaacagtccatcattaagaacaacacaaaggagaaacactggttccaacacaatgttttttgacatggtaccagctgattcctggtacctgatacataaacttacatgagatactgggtgattatggtcatggaaaacaattagcattcttcagacttatgttgtaattaggcctcaactttgctctatcagaggttaacagttaacagtgttgatcaaatttctaattatagatacaaatgtgggaggggaggtataaagagagctttataaagatatgctgtgcttatgcatcaggtacttatttctgtctgtcttaactggagctgcttattagtgttaataaaaaaaggaacgtcagggcacagtggctcagatctgtaatctcagcactttgggagcccgaggaaggtggatcacaaggtcaagcgattgagaccatcctggccaacagggtgaaaccccgtctctactaaaactgcaaaaaattagccgggcgtggtggcaggcgcctgtaatcccagctacttgggaggctgaggtaggggaatcgcttgaaactgggaggcggagagtgcagtgagccgagactgcgccactgcactccagcctggcgaccgagtgagattccgtctcaaaaaaaaaaaagcaacaaggaccaaataagtgaaataagtgttatctctctttggaggtgatgctagtaagtgaaatcattaaaaagcagaagaaaaaaaaaaagaggacagaaattctctaatattatttgaataagaactaaagatataggcatctttttaaaccatttctattataaatatcatgctgaattatgaattagtaatagatgatctatagagaaaggctcttgttctaaaatttcaagtactagaagtagcaaaatataaagagaggccatattacatccattcaactcacactgagtcaaaatcacctactttaacatttagttattttgttttttgagatggagtctcacctcagccgcccaggctggagtgcagtggcgcgatctcagctcactgcaatcactgtctcccgggttcaagtgattctcccatctcagcctccccagtagctgagattacaggcatctgccatcatgcccggctaatttttgtattttagtagagacgggtttcaccatgttggccaggctggtcttgaactcctgaccttagatgatccactcaccttggcctcccaaagtgctaggattacaggcgtgagccaccaagcccagactagttagtgctatgttatgtatactctttgtaaggtagaggaatctagaggaggcataccagcttctaaatgattttaaacgtatcatttctaaaaggaaatgatatttcacaagtgttgaagaatgaatgtatgagactgagagactgaaggggcatgtatgttaggggagtcaggataggaaggaggcatgctaagtaaaatgaatagcatacacaattctccagtgtcaaagtttataacccattggatctgtctggatcacaaccactaatatgtacgattcagggaatgctaaatttgaggatctgaaggaagaccacactggaagaacagagaagtaatgtcattaagcagctcttatgctatgccaaaaatctggacttcatctcagtcaagagcaatgctaaatgaccagcatgcacagagttagattttagaagtatcaccctggtggcaagagagaagaaatgggttgaaacagaggtggtggtataaaaatagcaaggtcatttaggaagttattgtcactgtccaggtaagaaacgatgagaccttcaaatagggcagtgtgtttcaggataaagtaaaaaaatttaggaggtggaatcaaaagaacttgctgactagatgtggaaaggagagtgtgtggagtcttttaagccaggtcaaatgaggacactccagggaaagtgcgggtcagtcaggctgaggcaaaatgctcctaccttagcagtgctgttgatatcatcagggtccccctcctcacactcgaagagagtcacatgggtgaggttctcaactggatttgtaagagtcaggaggacctggctctcctggtgaataggaaacacatctctcagacattcgccactttcttagctgctataccgaatatttcgcaaaattaccatccccgccattactcctgggcaatgacgccctacttatacctctacatcactgtattctctatgtgcttactgatccctgttctattatctatatgttagaccaaatactctctggagttgctatttcactgaggaaatgggacagattccactgaaagggccagttactagatccagaaattctgaggaatgttcattatctaagtgaagttaaaactcttgtctcacccaggctgccacttaaggactgaaaaggaggccctcataaataaaatatgggagccacaggccagtcagatgcatgaacagagcaaaaatggcacaccaagactacaaaaactttttaaaatttttattatttatttatttattttcgagacaaggtctcactctgttgcccaggctggagtgcagtggcatgatcatggctcactgcagcctcaacctcctgggctcaggtgatcctcccatctcagcctcctgagtagctgggaccacaggtgtgcgccaccacacctggcaaattttttgtattttttgtagagatggggtttccccatgttgcccaggctggtcttgacctcctgcacccaagcaatctacttatcttggcctcccaaagtgctgggattacaggtatgagccaccgtgcccgaccttataaaaactttttaagacttcttgaactgtgataatttgtccttgtttggtaccctctctagataagcaaaacaaatctttcaaatgaaggcccatgtaataaatatttgtgttttcaggagcagcatgaaagaagagttaaagagtttgctgcagaatattctacaattcactgggtgtgtgtgtggaaggaaggggagtagatgaggactccaaggaagagaagggctgtggtatataaatctaactgaatcctagtacctgaaacataacaaacaggagatcgaagagaatctctaggctggagaagaacaaaagatgcctgtgggatccaacattctctcctttcttttccccacctataatttcaccttaacataatgtgcaccctgctccttctccctacttttcatcagatgctgttgtcaagaatctcagtgtcaacaaatttagtctttattatcccaaactgtcttcttttctatcccttgctcactggatcctgtgccaaatacacacacagccacccacatacacatgtacacacatcattgatcaatcctttttcttcctgttaatgagcaaggtactaaccttcatgtagcgaaggttgggaattgacatgattctcacttctggaatataattgctgtgcataaataaaaaaatgcattaatgttcattggagtctcttaaaattattattattttttaaagctagtgcagtacataaaggatttcatgttaattagaatgtatcagaaaaaaaataattttaatgaaccatatcatcacagtaagaacttaagaaaagacataagaccaaactggtatgagttctttctgaaatcttacgtatatttctagttgaaactgcccaggccccagattagcatttacatatcaagatattgctttgtaatgactaaggcaagatatttatctccttgtgccttggttttcccaattctaaaatgaggaaaataatggtatctttcacttgaggttattgtgaagaatacatgcaagaatgctttgaaaagtgcttggaacaaagctcacataaatgttcattattgtgcatacattaacgtaatacgaaatctattgcagaaacattaaaagtgggggaaaaagtacatcttagaatcagatatttaaactttaaacgagctatttttcatggtgaccagcaggattacctgagtaacttaacaggaatttaagaaacttttgtcttcctgaatctcaaaaaaaacacacacacacacaaaagcaacaacaataaaaataaatttaaagaccccacttctaagaatttgaattcagtaggtctgaggtttgataccagagctctgtatttttttttttttttttgagacagggtcttgctgtcacccaggctggagtgtaacggcacaatcatgactcactgaagcctcgaccccccaggctcaagtgacattcccacctcagcctcccaagtagctgggagtacaggtgtgtgccaccatgctcagctaatttttgattttttgtacagatgaggactcactgtgttgcccaggctgggcttgaactcctaaggctcaagcgatcctcctgccttggcctccccaaatgttgagattacaggcatgagccaaacacctggcctcagagcatctgtattaagatagccaggcaattctaaaatgatgtcagaaaaaaatcactttttctcaaagcaagcttaagaaattgatgctaagtacaggctgccattcagggtttctgtaatgagtataattcttaagaaaggagttcatcccagacttcacaagtgccatttctgtaggtctctaaccaatcatgtattaagagtagttaggaaaatgaacatattttatggtgagttacaaggcatttgcaaacataattactcatttgattcttttcaagaatcccaagaggaatacattattcccatttcagagacgagggaagtatgtttagacaaaaatagtaagtgacagaccctcttcctggccctcctagctcctcctaactcactagacatgcacttcccaacctttttgtttcctaatacttatttttaattgctgcataatattctacagtacaagttatctcaatttaaccaactatttccttgttaatggttaatcagtttgacactgattaacttttggttaaactgtttgcagctttttgccattaatatattctaaaacacacctttggaaatgcatctttatatattggtgattttgtttctacagaatatatccctgaaacagtactgttgggttaaaaggtctatgtaatttgttttgatatttccagaccactctccaaaaagactagcaattcaagatcccaccaacaatgtgtgcaagtatgtgtttacccacattctcatgagcactagatgctaattaccttttaaaacttttcctatcaaatcttagtttctttccatatacagtgtatcttctggtcatttgaaattcctttcccataagctacctgttcaaatcccttgttccacattccactttactgcctccctctatttttatcttttcaatttctgggaattctctatgcctgggatattaaacttttgtttgtcatgactgccaaatattctttcttgctttactatttgtctcaggactttgttgctaattttgtcttaaaaaaatttttttttccttagagagagagtcctgctccactgtctaggatggagtgctgtgggacaatcatagcttactgcagccttgacttcctgggctcaaggggtcctctcacctcagactcccaagtagctaggactacaggtgcatgccactacacctggctaattttaaaaattttttgtagagatggggtcttactatgttgtccaggctggtcttcaactcatgggctcaagtgatcctcctgactcaggcttccgaagtgctgggatcacaagtgtgagccactgcacctggctttaatttcatcttttataaccactatttctttttgctaaggtcaaaggtgtttcttttcttttaatggcttctgggtttcctgtcttgctaaagaagggctctcttactccaaagctagacaatactttcctaatttgtgaaaatatttttgtttgccaggtaatttaaaaaatttatgtattagaaaagtatgatgagatatgaaaagtttacatttaattagatgaacactgggtaagttttaagtggcagtatttgtctctaattaggaccattcagatagcctgataggtagtttttatacacaaaattctcttctactcacaagtcccagagagttaacactaacttaatcactttcattccagtcaacgaagtgttataacacaggtaagtaaaatgaacactgttacagggatactcttcaatcagctatacttcattatttttaaattttttttgaaggattattcccaaactcagatactttataatttgtaatgatgactagtgactttccaccaaataatcaacataccttgttgctccagatcatactgggacactgtgtccctgatcccaatacccctgaatctatttatcttaaacttcatggcatgtaactaaattaaaaacctaaacaggaacagaatgtcaagattattttgatgtaatttttttttttttaggccaagagtaaacacacttcatactggggaagaagaataaaccaaaataactcaaaacagtaactgaaaacaccaatcccaaaatacttacacagcgaccagctggattttgaatttgattgacgttgggttaaattctggcttgctcaaattatgttcacatttctaaaaagaaaacaaatataacacgtatcagaagacaacaacacactttgttgatccatagagctgctaaattcagaaggacagcatttacgagaattttgttttgttttgttctgctataagaccatatgtttttgaataatgtatagcagccaaagtttataaaagatgttcgcacttcctgatatgtgcaaccccactatccaatattattatacctctgtggtacttaaaaactactaaaataacacatactgagtacatactgtatttgctaaacaacgtgctcactggtttaactggatttaaatatcacatcaactttatgagctaggtataggtattacattaaggttgccatattatagatgatcaaaatggtatacaggaagggtaagtaacctgtccaacttcacagagccaataaaaatggacactgggatttaaatctaggtagtaaaattccagatcctatgctttaaagtacagtaacaatgattacttttgagatagggtatcactctgttacccaggctggagtgcagtggcacaatcaaagctcactacagcctccaactcctgggctcaagtaatcttcctgccttggcctcccaaagtgctgggattacaggcatgagccactgcactaggacagtaataattatttactactttcttaaatacatactacatatacctggttaaaaatttttttaacagaacaaaaaaggtgtccagtgtaaagattacccattatctgtctgtccccttgttttctccagatagcctatgcacataaaagtacaagcatacatcaccttgcttttttcacaataacacaaaagggaacattttatatttattctcttgcttttttcatttattctatcttggaattaattccatttcagtacatatagagaggcctctgtgtcccactgtaacaatttctataacttacataagatagaaattgatggacattcaggatgtttccattattttgctactgtaagtaatgcagcgatgagtgttcttgtacatgaatcatttcctaagtgtctaagtatctgtaagacaatttcctaagagtagatcaaagggtgtatgcatttgctattttaatggatactgaaatataactgactaatctgacgattatgaaatgatattccactgcagttaattttttttaatttttcattttctcattgcagttttaatgtacatttccctgattagtgtataaatttgaatatctttcatatttattggctattgggatttcctctgccataacttgaatgttaggatctactggttatttttatttccttgccgatttgctgatattaacaatagattttaatctcttgttaataatataccttgcaaactacttttctcagtctgtggcttatcttttcatttctttatgggttttctttggcatgagggtacaagttttacttttaatgaagtaaaatatgtaactttacattacagtttgtgcttatttgtattacttatgaaacatttccctacccagaagtcatgaaggtattctcctctatttccttctagaagtttggctcttcagatttccaatgttcctgaaattaacttctatgtagggtgaggtagcaacccaattttattttcttccatataatcacttgacctagcaaaatataattgcctattctttccccaatgatctacaatgccatatttagtatataacaaattttctcatatgcatgggtctacgtctgcatacatatagacacacttttttttgtttatatgtacatttgtactttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaagcatcatttttacatgaaaagttgtctgtcatttgaaattatgcaaatgatgtcttgacctgaagcacaaaccccaggtacttaatgtttttaataatatggtgccactgcaggggttaggggcggtggggaagaacaaggataatggcggggaggattggcctaactaaccactaagtgaattgtactgcagctttgatttatgagacatccttatctgggatatttgagggcagctgcaaactaaaaacaatccagtaaatgtactttgtttatattttgtatcaggcaattatcaactgctaaataatagctttcatatttgcaactgttgcatacagagtacttttgctaaaaggtgattagctcttgcctttaattttacagtgcttaatgtgataaacttccagacatgtttcctataaaagagaccatttaatatatgtatataaaccacagtaatagtataacatactattttaaaattatttttttctacttaaaatatttaattttaggcttcttaggacatttctaaagcagattaaacccaataagcaggccgggcgcggtggctcacgcctgtaatcccagcattttgggaggccgaggcgggcggatcacgaggtcagaagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaacaaaaaacccaataagcttcctgatgatttttttgtaattggagatagttttctcaactgaaataacatttcagctaaataaagcattttaaaatattgatatttgataaaaaattgccttgtataatttctgtaaattatatttgttctgaaaaaggtataatgccctaatgttaaaagattttaaacaaatccttatcctttgatttttaaaactctgatctaatgataaaattctataaattttcattttcccgtgcagttaggtagcaaaatagctggtaattcataacttttacctattaaaatataaacacacaacaagcaaatgtatttaagagtactaaatggaaataaagtgttcaaaagagaaagtcttgtgttattgagcatcttagcctatttattattataaagtataaatgtgacttaaatcttttcttgttaataaaaactttcttttaactgaaaaagaatttcatcttctgaaaaatgttcagacttactttataataatccagtatataatcaacctttataagtgttctgtgtgtacttgaaaagaatgcatatattctgcagacattgggtacagtagtctatatatgcccatttggtcaagtttgctagataaattgtccaaatgttctatattcttactgattttcatctatttgttctctcggttactgagagaagtatgtcaaaatttcccaaaatgatttgtccatttatgtaattttctcaaatgtcgctttatatattttgagtctattattcagtgcacatgactttagacggttatatcttctttgtaaattgaatcttttttttaaacaaattatccctcttttaaaaaaattagtgtttgtccaatatttttcccacttctctctactttcaacttttctgagttctcatgtttgtgcttcttgtaataagcatatagatggatcactgcaatttgctttattatttagactgacaatgtttgtcttttaatggaagcatttagttcattggtatttaatgtaaatactgatacatctggattttaatctactatcttaccacacacaatcttttttttttttttaacagacagggtcttgcttcgtcacccaggctggagtgcagtggtgtgattactgctcacagcagcctcaacttcctgggctcaagcaattctcctgcctcagcctcctgacttgctgggactacaagtgtgtgaaccaccacactggcttttttttttttttttttttttttttttttttggtagagacagggtctcactatgttgcctaggctgatctcaaactcctgggctcaagtgatcttcctgccttggcctctcaaagtgttgtgattacaggcatgagcccaggctttctatttgaactaccaattcaatgttcctttgccccttctttttctttctttttataaaggtttttcattatagaaattttctaacgtgtacaaaaatatagaatggtattacaaatctctaggtacccatcacccaacttcaacgattatcaacttcggaatatatatgcaggacttgaatctatgctctcaggttaaacaaacaaaaagaatcagcatcttgttatcaaaaattagcaacaatggccaatcttgtttcatttatactcttacccattcctcatccctcattattttgcaacaaatatcagagaccaagtcatttcctccataaatatttctgtatgtatctccaaaagataaagacattaaaaaacaaacaaacaaagtactatcattattcctaaaaaagaaaaaatactttttttttttttttaagagacagggtctttctgtgttgcctaggctggagtgcagtggctattcacaggcaccatcatcacacactacagtctcaaactcctcaggctcaagggattctcctgcctcagcttccagagtagctgggactacaagtgcatgtcactgtgccctgcccaatagttttttaatagcatcgaaaatgctaccagtgtttaaattttctcaaagatttcacaaatttttctttccttctttcctctttcccttcttccctcctcccctgggccctttctttctgttttgtttgaatccgaatctacgtaaactctatacattgtgtttggtaaacttttaagtctcttctaatctagagaatgattaagtaacattagccactagcgacatgtggttatttaaatgaaattaaagactgactcagtacctcagctgcactatcacatttcatgtgctcaagagccacatgtgcctagtggctatcatgcgggactgtacagacacagaatacttccatcaccatagaaagttctgttggatagtactcctctaaaaggtttcttttccattttgtttttacaatttatttattgaagaaactctgtcatttgttctgtagattaccagagcctggattttgctgatttttcttgctttcttttaaattgattattttttattggtcctccctgagcctgaacactagcctaaaagttcacactctttcactattcttttaggggttaaccctatgtacttaaccttcagatacttcattttctacatttgtaaaacaggtttaacagtagtacctacctcacagagttgtaagagctgtttatattgaaagcatttaaaatagtgcctggcaattagtatgttctctacaagtattttctgtatttaatacattccaaaggttttgacattagtcagacaccagccacatttatttttgctttcctcttgtacaaatggtcagtctacagaatggaatacttacacggcagcgcagggaccgtttgatcagaagatgtttgtggcgaggatagagctgtgaagcacagactggctggaagtcaggctgtaacagacgctgctgaagggttgttactagaaagaaaggcagaaaacaggcttagtttacagtgactttcaaaatcagacttttatgtaccagtaattacacgaagcattactgcctttacgaacagtgttgttcataaaaatgaaaatatagaaagttgacattttagatttcaaacaattacctctattacagctgttttattttctacatattgtttttactactaacagctattccattaaaaatctcaaatcactaggtacataaataacaaaaacagaattagatgtagactagaaacaaagtagaaaaacacagaaaattaccctctgttaaatttactggtcttgtataatagtcttcaggtagaggttccacttcatccacagcctgagctggctcaatctttatctctttctgatcctctccttctttaaggctgaaaaattaaaaaaacaaaacaaaacaaaacaaaagagtaatttctcacggatccacctgattatcctcagtctatgatatcaataattgaagtattcctctgtcatagaatatctgtatagcgtaggtcttttctaagtatgagaatcttcttttccattgacaactgtgtgtgtgtgtgtgttttaatctcatttatttgatattcattttgatacctgctgttctcctcaaagtcatttcatgtctaaacttacgaaagtccggcaagggtactgatggatgcaccagctcgtggtcgctgaagcctggttccaagaccatatttgtcctaaacaaagttcagaaattcctattagaaagtccacttttacacaccctatttatcaaaagaaagaattttgggtaggatagcatgagaagctcagggaaataagcaaaaaaaaagctaatctaaaggcttcttttaaagaaagcaatttgtagccccacatcattattctattcttaaaataataacagcactaaacatggagattgaaactatattaatacagtaaaaatgaaccaaatgtgagcttctgctagtaatctaaaagtatctaagctacggctcaggcaagaactatgtggagtgtctaagatacacaacagacgtcttcctggaacaccagtggtcatctgctaacttcttcagggtcagcaagaatcataaaggagaacttaccactacatgaatagtatgttgctgtagagccccaaaatagcagcaggttgcaacagagacaaaaaatgcagcataagatagaagcaaacgcatatagcaggcaggttatatgggaaaattggaagaataattcatttaattcaaattctacctctaaatataacacacattggtgcatatgctgactataccactggactattcagaaaaattcacttctttttgcaaatgtaggtgctttgcaagtgttaatgtttttaaattctaatctagattttttttgagacagagtctcactccgtcacccaggctggagtgcagtggcgctatcttggctcactgcaacctccgcctcctgggttcaagcgattctcatgcctcagcctcccaagtagctgagattataggcgtgcgccaccatgcccagctaattttttgtatttttagtagagacagggtttcgccatgttggccagactggtcttgaaatcctgacctcaagtgatccccccgcctcagcctcccaaagtgctgggattacaggcgtgagccactgcacccagcttaatctaggtatttttatatggactttaccaacccttagggtttcaatgacttaactaattttcatgtggatgcagtatgacaagttgcttaactaggtcccatttcctcaagcgtaaaatggggatatgatactccacaggatttttgtgaggattaagtaaagtaatacatgtaaagtgtttatttagcacagagcttgacacatcattgccattcaataaatgttatttattgaatgtcaatttgctgggccccaagcaagcacacagaaaacaaactgtactatgagagcaaataaaactcggggtaaaataacaaaaattccaaatcctaatttctttcttcttactagcagtacgtaaactggtagagaatgactctcataaataattcttatcaaaaattctacttgcatatattactatttaaccacacaagtgcactatgtaaaaagtcagtgtttttcatcttggagaaacaggggaggatgttaaaaaaattataactaaagctgagaaaccactactgccaggatgtcaaaggtgggctacaggggtaatatgactgaaatctaccatttgcccacctccttcttctcagactttctgtaatacacaaaagctgtacgtggaactctgcagtgcctacaaaattaacagcctttctggggaaataatcagaagataaaggggagtgatggagaaagaaacacaaatgtcctcaaaacacaaataactcaaacagaactaatgatatagcaaaagcctaactattggacttaaacgtctataatttgaagaatccctctctctgatatccaccattcaggaatctaggacaatggccattttctgaaatgatcactgttcttaggccttagaggtcttgcaaatcattttagtaccaaattctcaccgaaaaagccagaggcatatagtttctacgtcgtgccagtttcttgcgatctcgctcaaccttctctttctgagcaagctgctggtaatattcaatcaatttgttcatctgtaagaaaatcacagactcagtacacaaaaaagctaacagaaaacatatcaaattaatcaactacactgactagacacataatgaatagagaagacaaattattaagatgggcaagtttgccctttttcttctaagataatttttcttcgttatgtgatctgttttccgaagtgaaatggaaaactgaagttcaaggatgggaagaaatgggcaatgaagaggcttggaaattttttgctctctaacttcattacttatttcccctcacaactgctcttattttttttctgcatggccacaggaccacttatttctaagaacatagcattttatactgtattttattccccaactccatcacactttttaatttttaaaatacattttaattataaaagcaatacatattaatcataaaaagttcaaaccaggatgggcacagtggctcacgcctacaattccagcactttgggaggctgaagtgggtagatcacttggggccaggagttcaaaaccagcctggacaacagagtgagaccttgtctctataaaaaaatgcaaaaattagctgggcatggtggtgtatgcctatagtcccagctactcaagaggatgaggtggcaaaaaaaaaatggcagataggaggcaggactaacttgcagcttcccctcagacagacagaacaacatgtggagactcacactgtgaatttttattccaagaactactgcaggaacatactaggaaaactgaaagaattcacagaccctttaaaagaagtggcttgctgctgcaaaatccatgagacagcagaaaatctgtgagtgcccatgtgtaagagggggaaaatccaccttcaaacacacatcctcactggagaacctaaaaatccagatcatgggagaaaaatttaaccttacctagtgctgaaacaaaatttagagagccgagtgaaatataaaaatagaagaagcaacagcgggaagagccctgtaggcactcccggttcccagtgaagcccagggaagtcatttctgactttaatctcacaggggtccttggggagtgctgccagtggaactgaggaaggaccacttggagacagaaacttccaggtgaactttgtaataactttgacggagagcaaattttcctgggcacaatcaagatggggaaggcgtaaaggggaagtacagatatgagcacataagccacagcagtcgggaaggggcggagtccaaaaggctagcttgctttttcagcaagtaggcttgtagcctgggccaaaatcttggccctgcaaaccccatgctgttggtggggcatggtgggagtgagactggccttgctggctgcatgggagctgggtgaagcctgtcactgctggctttcccctacttccctggccaccagtatgacacagcagaggcagccataatccccctgggaacataactccattggcctgagaaccacacaactgtccttcacagcagctgcagcaaaccctgcccaaggagattctgagctcagatatgcccccacctgatggtctttctctacctgccctggtagcccaagacaaaagactgtaaactcttgggagctttatggccccactgatcacctgggaaacccaaatacttatccaggcaaccttagggcaagcttgtatccccaccacactactgcagctgatgctttcttgaaagcgccacctcctggctggaggccaaccaactcattatagcaactcataaaagaacaaccctgccctcaaaaggagaaaacaacagctaattccaccacctgtgacatcctggctaaccagaggtcctgagtctgtccacgtgacaattcactgctagcacaaccagcattaaagaaaactagcatacgaaaccaaactacaaccaaggaccctcacagagtccacttcactctcctgctatctccaccagagcaggtgctggtatccacaactgagagacctgaagacggactgcatcactggactctttgcagacactccccagtaccagctcggagactgatagctctggccgggtggctagacccagagcagcaataacaataattgcagtccagctctcaggaagccacagggggagagcaccacatcaaggaacaatgtcgtaggacaaaataatctgaacagtagccctcaagccccagatctttcctctgacatagtctacccaaatgagaaggaaccagaaaaacaattctggtaatatgacaaagcaaggttctttaacaccccaaaaagattacactagttcaccagcaatggatccaaaccaagaagaaaactctgaattgtcagaaaaaaaatttagaaggccaactattaagctactcaaaaagctactcaaaggggcaccagagaaaggtgaaaaccaacttaagggaattaaaaaaaaaaaaaaaaatacaggttatggacaaaaaaaatctccagagaaagacagcataaataataaacaatcacaatttttgaaatgacagacacacttagacaaggcttttgaattaacccaatctgacaaatacaaagaaaaaagaataataacaataataataaaaaataaagcctctaagaagtctgggattatattaagctaccaaaactaagaattggtgttcccaaggaagaagagaaatctaaaggtttggaaaacttacttgaggaaagaatagaagaaaacttccctggccttgctagagatctagacatccaaatacaagaagctcaaagaacacctgagaaattcatcgcaaaaagatcaccacctaggcacacagtcatcaggttatctaaagtcaagacaaaggaaagaatcttaagagttatgaggcaaaaacatcagataacctataaaggaaaacctatcaggttaacagcagatttcttggcgaaaccctacaagctagaagggactggggtcctatctttagcctccttaaacaaaacaattatcaaccaagaattctgtatccagcgaaactaagctttgtaaatgaatgaaggataaagtctttttcagacacacaaatgctgagagaatttgtcagtaccaagccagcactacaagaggtgctcaaaggagttctaaatcctgaaacaaaaccttgaaacacaccaaaatataacctccttaaagcataagtctcacagggcctataaaacaataacacaatgaaaaaaaaaatctaagtattcaggcaacaactagcacaatgaatagaatagtacctcacatctcaatactaatgttaaatgtaaatggcctaaatgctccacttaaaaaatacagaattacagaatggataacaatttaccaaccaagtatctgccgtcttcaagagactcacctaacacctaaggactcacataaacttatggtaaaggggtaaaaaaagatattccatgcaaatggacaccaaaagtgagcaggagtagctattcttatatcagacaaaacagactttaaagcaacaacagttaaaaaagacaaagtgggacattatataatgataaaaggactagtccaacaggaaatatcacaatcctaaatatatatgcacctaacactggagctccaaaatttataaaacaattactactacgcctaagaaatgagatacaaagcaacacaaaaatagtgggggacttcaacgctccaccaacagcactagacaggtcatcaagatagatggtcaacaaagaaacaatggacttacactataccctagaacaaatggacttaacagatatttacagatcattctacccaacaactgcagaagatacattctattcattagcacatagaatattctctaagatagaacatacgagaggccacaaaacacgtctcaatacatttaagaaaactgaaattatatgaagtactcgctcagacagcagtggaataaaatggaaaatcacctccaaaaggaactcttgaaacgatgcaaattgcatggaaattaaataatctccttctgaatgatcactgggtcaacaatgaaatcaggatggaaatttaaaaactctctgatctgcatgataatagtgagacacaacctatcaaaagctctgggatacagcaaaagcagtgctaagaagaaagttcatagcattaaatacctacatcaaaaagtctaaaagagtacaggagacaatctagggtcataccttaaagaaccagagaaacaagaacaaaccaaacccaaacctagcagaagaaaagaaataacaaagatgagagcagaactaaatgaaactgaaacaaaagagacaataaaaaagataaatgaaacgaaaagctggctctttgaaaagataaaccaaattgatagaatgtgagattaaccaagaaaagatgagagaagatccaaataagctcaattagaaatgaaatgggagatattacaactgataccacagaaacagaaaagatcattcagggctaccatgaacacctttatgcacacaaactggaaaacctagaggagatggataaattcctggaaatatacaaccctcctagattaaaccaggaagaaataggaactctgaacagaccagtaacaagcagtgagattgaaatggtaattaaaaaaaactgtccacaaaaaaaaagcctaggaccagatggattcacagctgatttctatcagacattcaaagaataatttttatgaatcctactgaaactattccaaaagataaagagggaatcctccctaaatcattctatgaatccagcatcgcccttataccgaaaccaggaagggacacaacaaaacaagaaaactacagacagatatccctgatgaacatggatgcaaaaatccttaacgaaatactagttaactggatccaacagcatatcataaagataatacaccatgatcaagtgggtttaataccagggatgcagggatggtttgaaatacccaagtcaataaatgtaatacaccacataaacagaattaaaaacaaaaatcacaggatcatctcaatagacagagaaatagcatttgacaaaatccagcatcctttatgagcaaaaccctcagcaaaatcagcatagaaggaacatgccttaagtaaaagccatctacgacaaacacagagccaacattatactgaacagggaaaagttgaaaacattccagctgagaactggaacaagacaaggatgcccacttttaccacttctattcaacacagtactggaagtcttagccagagcaatcagacaaggaaagaaataaagggcatccaaatcagtaaagaggaagtcaaactgttgctgtttgccaatgatatgatcgtatgcctagaaaaccctagagacttatccaaaaagctcctagatctgatcaatgaattcaataaaaggttgggcacagtggctcatgcctgtaacccgaacactttgggaggccgaggtggacagatcacttgaggtcaggagctcgagaccagcctggccaacatggtaaaaccccatctgcactaaaaatatgcgtggtagcgggcgcctgtaatcccagctactcaggaggctgaggtaagagaatcgctggaacttgagaggcagaagttgcagtgagctgagtttgcaccattgcactccagtctggctgacagagagagatttcatctcaaaaaaaaaaaaaaaagttttgaattcagtaaagtttcaggatatgaaatcaatgtacagaaatcagtagcactgctatacaccaacagtgaccaagctgagaataaaatcaagaactcaaccctgtttacaacagccgcaaaaaccccacccaaaaaacaaaaacaaaatgcttaggaatatacctagccaaggaggtgaaagacctctacaagaaaaactacaaaacactgttgaaagaaatcacagataacacaaacaaatggaaacatatcccatgctcatggctgggtagaataaatactgtgaaaatgaccatactgccaaagcaatctgcaaattcaatgcaattcccaccaaaataccatcatcattcttcacagaactagtaaaaacaatcctaaaattcacatggaaccaaaaaagagcctacatagccaaagcaagactaagcaaaaagaacaactctggaggcatcacattacttgacttcaaactatatataagactatagtcaccaacgcagcataatactggtataaaaataggcacacagatcaatgaaacagaatagagaacccagaaataaaccaaatacttatagccaactgatctttgacaaagcaaacaaaaacataaactggggaaaggacatcctattcaataaatggtgctgggataattggcaacctaaatgtagaagaatgaaactggatcctcatctctcaccttatacaaaaatcaactcaagatgtatcaaagacttaaatctaagacctgaaaccataaaaattctagaagataacatgagaaaaatccttctagacattggcttaggcaaagacttcattaccaagaacccaaaagcaaatgcaacaaaaacaaaaataaatggaacttaaactaaaaagcttctgcacagcaaatgaaataatcagcagactaaaaagacagcccatagagtgggagaaaatctttgcaaactatgcatccaacaaaggactaatatctcaagtctacaagacactcaaacaaatcagcaagaaaaaaaacaaataatcccattaaaaagtaggcagaggacatgaatagacatttctcaaagatacacaaatggccaacaaacatatttaaaaaaatggtcaacatcactaatgatcaaggaaatgaagatctaaaccactcctgcaagaatggccttaattaaaaaaaaaaaagtaatagatgctggcatggatctggtgaaaaggggacacttttacactgttggtgagaatgtaaactagtacaccactatggaaaacagtatggagattccttaaagaactaaaagtagatctaccgtttgatccaataatcctactactgggtatctactcaagaggaaaagaagtcattacatgaaaaagacacttgcctgcacgtttatagcagcacaattcacagccgcaaaaataggaaaccggtccaaatgcccatcaatcaatgagtggataaagaatatgtggtatgtatacaccatggaatactactcagccataaaaactagtgaaataatagcatttgcagcaacctggatagtgttggagaccattattctaagtgaagtaactcaggaatggaaaaccaaacatcatacattctcactcataagagggagctaagctatgaggatgcaaaggcataagaatgatacaatggactttgcggactcagggggaaagctgggaagggggtgaggataaaatactacacattaggtacagtgtacactgctcaggtgataggtacaccaaaatctcagaaatcaccactgaataatttatccatgtaagcaaacaccaggtgttccccaaaaacctatttttttttcttttaaatggctgaggtgggaggattgcttaagcctgggaggttgaggctgcagtgagctgtgatcatgcaactgcatgccagcctgggtgacagagtgagatcctgtctcaaaaaaaaaaaaaaaaaaaaagttcaaacactatacacatgaaaagaataaaaagcaaaacttctcttttatcccttctgcccaagttgacttttctactcattagaggtatcaactattactggtttagatatctttcttactcagagaaacaaatatattatattttgcatatattttaaaatacttgtgtgtagatgtatagctttgatgtgtataaaaatacatacttattcctggcctcaagcaatcctcctgccttagcttcctgagtaatggggattacaggcatgagccactgcgtttgtctctaccgcattctttttctttttttgagacacagccttgctctattgcctaggatggagcgtggtggtatgatcatagctcaatgcagactcgaaaacctaggctaaagcaatcctcccacctcagcctcctgagttgctgggactataggcatgcgccaccacactcagctgaatttttaatttttttgtagagatggggtttcactgtattgcccaggctggtcttgaacttctgggctcaagcaatcctcctgcctcagcctcccaaagtattgggattacaggcatgagccaccacacctggctgtttatgatatttctaagagtatctgagaacaaatggaaccttaactcactggtgggttgtgtgaagaaaaaacaaaaacttggttccttttcctgatgcacaattcaaatacagaactaaagctacacctaggattctccattatcttaagtcatttggaaaaaagtgacagtgtatttcaatgtcttacaatgagaagcactgtctatgtgcaaagacgtattatggacttataaacacagctcatatctacccataaaatgcaagatcttcagtcttttactcaattttttccgatttcatcctctctctcttatgaccctttacttacccgttgtgtgtgaggattttcaggttcctgccaaccgccactagctacaaaataaaagaatattaaacaagactttcataatgtgataattttattttcataaaacaagtcttctgtaggccataaaaagaaacttaaaacataagttatatagaccattctggtctatataactatagactataatgttcagaacaaaattttaagaaaacatctaatgatggtgataacaatcaccaatgcacagccactgtgccaggcacttgaaatgtattacatttccttttattctcataacaaccctctgaggtaaggactcttattagtctcattttatatatgaggaaactgaggctcagagatgttaaataacttgctcaaagtcacacggagagtaagtggtaaagccaggattcaaactcagtctgactccggagactttgctcttatctgtaacactgtgcattttctaagttctatgaccttggcttagagaagaatttcttacgtaagaagcacacagcataaatcacaaaggaaaagattattcaagaaaactgaaagtactgaaagtaaaactataatgaacacttttaacaaatggtgctgcaacaatggaatatccacacatcaaaaacaaaacaaaaacctcaaaaaccaaaaaccaaaaggacccttacttcaacaacatttacaaaatttaccttgaaaagagcaagacttaggaggagccaagatggccgaataggaacagctccggtctacagctcccagcgtgaccgacgcagaagacgggtgatttctgcatttccatctgaggtactgggttcatctcactagggagtgccagacagtgggtgcaggacagtgggtgcagcgcaccgtgcgccagccgaagcagggcaaggcattgcctcacttgggaagcgcaagggatcagggagttccctttcctggtcaaggaaaggggtgacagacggcacctggaaaatcgggccactcccacccgaatactgcgcttttccaacaggcttaggaaacggcgcaccaggagattatatcctgcacctggctcggagggtcctacgcccacggagtctcactgattgctagcacagcagtctgagataaaactgcaaggtggcagtgaggctgggggaggggcgcctgccattgcccaggcttgcttaggtaaaaaaaagcagccacagctcaaggaggcctgcctgcctctgtaggctccacctctcggggcagggcacagacaaacaaaaagacagcagtaacctctgcagacttaaatgtccctgtctgacagctttgagcagagcagtggttctcccagcacgcagctggagatctgagaacgggcagactgcctcctcaagtgggtccctgacctctgacccccgagcagcctaactgggaggcaccctccagtaggggcagactgacacctcacacggccgggtactcctctgagacaaaacttccagaggaacgatcagacagcagcattcgcgattcacgaaaatctgtggttctgcagacaccactgctgatacccaggcaaacggggactgaagtggacctctagcaaactccaacagacctgcagctgagggtcctgtctgttagaaggaaaactaacaaacagaaaggacatccacatctgtacatcaccatcatcaaagaccaaaagtagataaaatcacaaagatggggaaaaaacagagcagaaaaactggaaactctaaaaagcagagcacctctcctcctccaaaggaaagcagctcctcaccagcaacggaacaaagctggatggagaatgactttgacgagttgagagaagaaggcttcagacaatcaaactactccgagctacaggaggaaattcgaaccaaaggcaaagaagttgaaaacttcgaaaaaaatttagacgaatgtataactagaataaccaatacagagaagtgcttaaaggagctgatggagctgaaagccaaggctcgagaactacatgaagaatgcagaagcctcaggagtcgatgcgatcaactggaagaaagggtatcagtgacggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcaagaagagcaactccaagacacataattgtcagattcaccaaagttgaaatgaaagaaaaaacttaaagggcagccagagagaaaggtcaggttacccacaaagggaagcccatcagactaacagcggatctctcagcagaaactctacaagccagaagagagtgggggccaatattcaacattcttaaagacaagaattttcaacccagaatttcatatccagccaaactaagcttcataagtgaaggagaaataaaatactttacagacaagcaaatgatgagagattttgtcgccaccaggcctgccctaaaagagctcctgaaagaagcactaaacatggaaaggcacaaccggtaccagccgctgcaaaatcatgccaaaatgtaaagaccatcgagactaggaagaaactgcatcaactaacgagcaaaataaccagctaacatcatcatgacaggatcaaattcacacacaacaatattaactttaaatgttaatggactaaatgctccaattaaaagacacagactggcaaattggataaagagtcaagacccatcagtgtgctgtattcaggaaacccatctcacatgcagagacacacacaggctcaaaataaaaggatggaggaagatctaccaagcaaatggaaaacaaaaaaaggcaggggttgcaatcctagtctctgataaaacagactttaaaccaacaaggatcaaaagagacaaagaaggccattacataatggtaaagggatcaattcaacaagaagcgctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaaccagaccttatagacatctacagaactctccaccccaaatcaacagaatatacatttttttcagcaccacaccacacccattccaaaactgaccacatagttggaagtaaagctctcctcagcaaatgtaaaataacagaaattataacaaagcgtctctcagaccacagtgcaatcaaactagaactcaggattaagaaactcactcaaaaccgttcaactacatggaaactgaacaacctgctcctgaatgactgctgggtatataacaaaatgaaggcagaaataaagatgttctttgaaaccaacgagaacaaagacacaacataccagaatctctgggacacattcaaagcagtgtgtagagggaaatttatagcactaaatgcccacaagagaaaccaggaaagatccaaaattgacaccctaacatcacaattaaaagaactagaaaagcaagagcaaacacattcaaaagctagcaaaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatatactctcccaagactaaaccagcaagaagttgaatctctgaatagaccaataacaggctctgaaattgaggcaataatagcttaccaatcaaaaaaagtccaggaccagatggaatcatagccaaattctaccagacgtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatgcagcagcacatcaaaaagcttatccaacatgatcaagtgggcttcatccctgggatgcaaggctggttcaacatacgcaaatcaataaatgtaacccagcatataaacagagccaaagacaaaaaccacatgattatctcaatagatgcagaaaaggcctttgacaaaattcaacagcccttcatgctaaaaactctcaataaattcggtattgatgggacgtatctcaaaataataacagctatctatcacaaacccacagccaatatcatactgaatgggcaaaaactggaagcaatccctttgaaaactggcacaagacagggatgccctctctcaccactcctattcaacatagtgttgggagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcgaggagaactacaaaccactgctcaaggaaataaaagaggatacaaacaaatggaagaacattccatgctcatgggtaggaagaatcaatatcaagaaaatggccatactgcccaaggtaattgatagattcaatgccatccccatcaagctaccaatgactttcttcacagaattggaaaaaactactttaaagttcatatggaactaaaaaagagcccgcattgccaagtcaatcctaagccaaaagaacaaagctggaggcatcacactaactgacttcaaactatactacaaggctacagtaaccaaaacagcatggtactggtaccaaaacagagatgtagatcaatggaacagaacagagccctcagaaataatgccgcatatctacaactatctgatctttgacgaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaagatccagaatctacaatgaactcaaacaaatttacaagaaaaaaacaacctcatcaaaaagtgggcaaaggatatcaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaatactatttgacccagccatcccattactgggtatatacccaaagaactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccacaaaaaatgatgagttcatgtcctttgtagggacatggatgatattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataagaaaaaaaaagaaaaaaagaaaagagcaagacttaaatgtaagtgttaaaactacagcacttctagaagaaaacatgggtagatcttagtgacactgggttaggctaaagtttttttaataggacacaaaaaacacaaactataaaataaaaaaattggtaaattagacttcactgaaattagaaacttgagttcttcaacacacactgctgagaaaaggaaaaggcaaggcacagactgggagtaaatatttgcaaaacatatattcaacaatggacttgtatccagaatatagaactcttataactcagtttaaaaaaccaaatcaaaacaaaccaacaacaacaaaacccagttaaaaagtagggaaaagatttgtacagacagttcaccaaagatatatggctggtaaacaaacacaatgagaaaatgcaaattaaaaccacagtgaagtactgctgtacatgtgctagaatggctaaaatgggtaagactgacaatatggcaagggttgtcaagggattggaactctcctaatttgctggggaggatccaaaattgttcagtcactttggaaaacagttgggcattggccaggtgcagtggttcatgcttttaatcccagcactttgggaggctgaggcaggagaactgctagagtccaggagttggagaccagcctgggtaacatggagaaaccccatctctactttaaaaaataaaaaaaaataaaaatagtttggcagcttctagacaaattaaacatacacttatcctatgacctaataatttcactctttggcacttaagaaaaatgaaaacatatattcacacaaagagttataggcaaatgttcatagcacctttattcacataagccaaaacccaaaaacaatccaaatgttcaagtggagaatgaataaacaaacatgttcatacaacagaatactactcaacaataagaagaaataatataaagaagaaacacagatgaacctcaatagcattatgctaaataaaagaagacagacaggaaagactgtaatgtaagactccaattacatacacttctagaaaaggcaaaattctagtgatagaaagcatatcagtctagtcaggggccgggaggttgggggaagaaactgactgcaatggggcatgaggattctctagggggacagaaatgttgtgtatcatgattatggtggtggctatgtgattacacacttgtcaaacatcacagaattctacacttaaaattggtaagctttattatatataaattatatattggtaaagctagccaaataaagggaaaaataaaagtataatgagataccatttcacaaccatcagtctggaaaaattttagagtccaaaagtactaagagctgacaaggaactggagctacaggtagtttactcttacatattactactaggagcaaagactgctaaatcattttggagtgctaaggatgtacacaacttatgactggcaattttacttctagttatatagaaaagtccttacacttgtgccttaggaaacacatacaagattgcttccagcagctatattttttcaaaagcaaagaaaatgaaaacaacctaaatgttcattaagagaagacggaataagtaaactgtggtgagtcatacaggaatcaactgtgtatcagaaacataatgctgatagagtaaagttgtagcaggatatatacagtatgttttcatttgcttaaaagtgaaaaatgttatttgtttgtggctgcatacatatgtggagaagtataaagacatgtatggatgctaataaacactgaattcaggattgtgattattatctctagcgggcagagaggaagataaagtagggggagggcttaaactgttttggctgtttcatttcttaaactgggtgataagtacatgaatatacatatttcatataaaatcacttttttcaaaacaaaaaggacgcaattaccttgctgaaggtgacattgtatcctcttgcaagaaatggcagaaataacactttagtataatattattttagaagttgcctcacttaaggcaatcatgaaaaataattatgtgaaagaaatgtttcagctgtaatatttttaaacgtctgaatattttatctaattgcttcttttgaactggtaatttattctaagtagcaatttgggagacataataatctcattgtaagtttttctccgtacattacagacaagtacttataaataaacaaatagttctaacttaagtggtttcagggcttctgagataccaatgacatcaaggaggaaatgaaattatctgtacgctttaagagctcctggtattcaattatccctgttgagataccctagaggagatacagttctagaagccagcataagtttatagttctgaaatataaattctccaatcttcatgactcataaaccaaaaagcataaaacactcactaacagagtaacaaactgagaaatctacttggatttccgggctgtttcttttacttgataaaaagacacaaaatacaaacatgaaaaaacaatactttagttcactgaggcctacattatgccactttgaggttgctttttaacatttaacttactttctttaacttatctcctatactgacactaaaacatatacacataaatacttactggcaattttcaaagatgttacagaatctttctattttcagtcacacttcaggtaaatagctacccaccaatgagcatttttaaggaactaagatatacttatttaactttctgtttttgaaaagagtatgtattttatcaactcaatgtacaaagtcagaaaaaccatcaacagctcaaagcattctaaaccaaagagcaaattcaatagaatcaaggattaaatttttaagaacatagttgaatctaaagaacttcacccatatttacttccaaattgtgtaagaatctatagaaaggttttagccagtctgcttcattttagttatgtcaaatgacatataatgaatttgttatgagcttcctcatttattagtcaataagctgtactttttatgaaaatcccaaaatgagaatttttacaagtttaaaatgtttttagaaaattaaacaatgaaacctcagaaaaaaaaatacggagttagtgatgctactacttatataaagcataaatagcaactcaagattttattaattttttttaaactttggatcacttaaatcaaaagcaactcaagattttgaactgactgtacagagaatgtttccactctatgatgttaaccatgaaatacagaatttgcaaaaataaagtttcgtgataaaattaagtgtaatctgttctaaaacactcaaacactcaaatgatggaggtatataatgccttaggtggtcttaaatccaaacataccaatttttctctttcactgataaacattttatatatatacgtaaaagtttttgagcacatgtttgaatgctccaggacagacatttggacattgaattactgggcagaaggatataagcaatttaaaattttaataaatgttttaaaattggtctccaagatagactaccatagtgtatgagagaactattctcctatgttctagccaacacttgatacaaccagattaaacatgttgtaccaaatagaaggaagctttaatttgcatttacatgactactagggaagtcgaatacatctttttgcatattcattgaccatttttatttctactatgagaattgctgctcatatcctttgcctgtttttctactaagtctttttcttattgacttataagcgttcctcatttctgagtattcatctttagcctgttatataagacccaactatttttcttagtttgtcatttttatctttaaagattttttttttttttgagacagagtcttgctctgtcacccaggctggagtgcagaggcccgatctcggctcaccgcaagctctgcctcccaggttcacgccattctcctgcctcagcctcccgagtagctgggactacaggtgcccccaccacgcccagctaatttttgtattttttagtagagacggggtttcactgtgttagccaggatggtctcgatctcctgaccttgtgatctgcccgcctcaacctcccaaagtgctgggattacaggcgtgagccaccgtgcccggccttatcttttagttttatccatgatgtcttaacatgaatgtttatttttcatgaagagcattaatattttgattccaagaaagtaccagatttataaaagctattttatcaagtctaagaaaactaaatattatcccatctcagataaaacactaaggtctacaaatgtgaacatatgggaacacagaagagttaatgacaaaatattctgaatttagctcctatcgccccaacgggttacagaaataataatctatgggcaattatagcactgtcaattgtacaaaatttcatattgaagtccatctcactcacctacagatttgtctgccatgcccacatctctagacgtccagcgacaaaatccacatgccaggtaataggctttcttcatggtggtcttggctgggtcatctggaagctgtgtggagatgctcgtggcccgagtagagagggtgtgcatgcagccaggacagtcaaaacaattggcacatctgtgacatgacaaacacaaccattcattcaacaaatatttatcaaggaattcaagagagaacaaatataaggacaagtgtctctcaagaaaaaacagtaacattctgcaggcctcttaccaactttgctttaacagttcaagagtactatatgttcattagtttaaaaaatatgcagttatcgccaaagtaagaattagagcccaacccaatcctactccacagagagaaccattgttaacagatggagtttatgattccagactctttttatgcttatattgatcacaaagatttctgaggaagagaactgtcacagcttatgcctttagagaggacagaccaactgtgccatagaaaacttagagtcaacaatacaagaagctgtgaaactggatttggaaaataaccgactgctgtgccagagagcttcaacagaaagcaaacaatgctatcaaactggaatggttcagaagcagcatattttcagggctttctgttctctccttaaatgctacttttcctagtgctcagccaacatttctcctttaggaggtccctatgtcttcttgcttttaactctcccaccagcacagattatcaagatttcacctgcagtcctgtacctgcttgaagttctgttctataatataacttgcattatctgttatagtctgccatctggatactatcaaaagaagataataatagtactcaccttacaaggaagctttgaggattaaatgataaaaattaatttgtggaaagtatacaaaacagtatctggttatcaggggttacttctcagggcaggaaagacaaataatagtggttcacatccataaaggtatgggggtatgactaacagcaaaaggactttcacttcaagctaaaaactaaacaccatccagtagcaatgagcaagcctagcagccatatcttggtttctaagactattctccaataaagtgaaccaaggctccttggagaaacaactctaagactgagacagaaaatatacaagatgaggctgggcacagcagctcacgcttgtaatcccagcactttgggccaaggcaggtgaagtgcttgagccaggagttcaagaccagcctgggcaacatggcaaaagcctatctctccaaaaaaatacaaaaattatccaggtgtggtagcatgtgcctagtctcagctactcaggaggctgaggtggaaggactgcttgagcctgggaggttgaggttgcagtgagccaagattgcaccactgcacttcaacctaggcgccaaagtgagaccctgtctcaaaaaaaaaaaaatacacacaaaacatacacacaagatgagtctggagtatcttgtagtactggtaagaaaatgatcaaagtaatgaacagagaactctctcctgctcctaatgatgggggtatgtcaaagggatctaggagtcaactgaaagagctcccaatggccaaagctgaaataatttgagcaaaataaataaagtagtattggattacaagccaaaatataaaatgaatattcataatcccactgtcctataagtaagtgatttaaaaaacaaataaacaagaggagaagagacagatcttccatgcaaaagaattccaaatccaaataatttatgcagatagtcctcaaggacaggggagcataattctctagtctttatgggctgtgacagtaattttccttccaaaaagtagagtacaaaaaaagaaggaaaagcagtaactttacagtggagaaacctgacaaacactagctcaagccagataatcaaggttaacaccaacagtgacaagtcataagtatttacccttgatatgatgtaatcaaagatggcactttacctctgtggttctcctccgcaaaatacattcccctagtctgatgagaaaaaaacatcatgcaaatcctaatgaaatgacattctataaaatacctcaccagtactcctcaatacttttgaggtcatcaaaaccaaggaaattttaagattctcctatcacaccacacccaagaggagtctagagacataactataaatataatgtgatatcctgaaaagaatcctggaaaaaaaggagaccacagaaaaactaaggaaatctgaataaaatgtagtgtattggttcattaattgtaacaaatataccacactaatgtaaaaagttaacaataggggagactggatgtgaggtaaatgggaactctccatactatcttcaccataattctgaagtacaaaactgttctaaagtagaaaatctatttcaaaaatcaaaggggatttcatctttggcaatggtgatgcttaaaaatgaaaaagagctggttaaaaaagttaatttcatgtgtcttttttttttttttttttttgagacaaagacttgctctgttgcccaggctggagtgcagtggcacaatcttggctcactgcaatgtctgcctcccaggttcaagcaattcatctgcctcagcctcccaagtagctgggactacaggcgcgtgccaccacacctagctaattttttgtatttttagtagagatggggtttcgccatgttagccaggatggtatcaacctcttgacctcgtgatccctgcctccgcctcccaaagtgctgggattacaggcgtgagccaccatgcctggcccatgtgtctttttaactagctattttagagaacagtcaaggaaaataggaagaaaaaaaaaatcagtccaggtcttacctattcttttttagtttggcttcagccgatggcatattttctaaacaactgggacaataatgggagtccacctaggaggaaacaagaaagaaaaaaaaaaccagaggagaactcagtttaacttgtgtatatgtcttgtcaaatagtgaattttaaaatatgttatactgtagcagaaagtagactgttttctgcttagggtttattcttcttcagtcacctgttttttttttttcttcttcttccggatttaaaaaatccttctatttttctgatctttcctattccatcatcagggttttatgtgttaaaagttgtttatttaacaatctacaatttccagttgaactccatagaattctatgattaataaagagattaataaaataatccaatttgtaacattgtgataaaatatcctcctgtctaggctagctttatatgactataaaacttgaccatacttttaggttttgaaggacatttttttaaagatttctcattattgaagtaatacaggttgactgaaggcaagcataaatatttatttacatagtcagctatggccaaccaattagagatttttaaacaaattaatgggacagtcttattgtacttaaaaaactggagtctaaaatttaagttcattttattttttaaaagtctgaataattattttctttaatgtaggtcctatttgacaattatagaactctagtcacctgcaaatgaaaagacaatcactggaacataaatactatgatagaaactggcttttttcatcatctgctataaacaggtcaatttgaaaagattaataaagttgttgctcaaataatctccaggaacataaaatacaatattgctaactaacctctgcactgactcatcaaaaaaggcaaaatacaagtcattcctttttgccccctttccaaattctgcttgtccgttcatgtgcagctccagacccagattctccattagaacttcactgcctgccccagccctcagagcttcatctttccctaaactctaatggcctccatatcacaggtacacatcaggctgtaaaagatgctgtcacagactggatgtcctaattgaagagagtcttagagacagatcatggagactgagcactctattcaccacaggagaatatgatccaataaattctggaggtggagctggaatagggaatcatcaaggagatacacataaggaaagtgctaatggagatgagaagaaaaatcgatgccatatttttaatatatacgatttttcttgtattatttaattgcttttcttgactattcctattatgaaaagtatcttcaataaaataagttattaataacacataaaatggcttatagtatgtgttttcatatgcatttattttaacagtcccgggatcttcagtaaaaaacactctgagttaggctgtttagattcaaatccaggtcctccttcccacccccaaattactggctgtgtgacttacagcgaacactctgtatctgtttctttacctgtaaaaaaaattttttaaaaaaagtatccacttaaattggtttgaagattacataaagcacatgacatatagcaagtatcgaataagcagcaactattactactatcagctttttcttcactaagactatggcttattaaacagcgcattttatgtcttactcgccttttaatccctaaagcttactgaataaacaagatgtgccaagcgctgcagaagttttggggttttgttatttggtgactttttactggccggggtcttctttttgaaaaatccaacttcggacgcccacttgtgccagggaaggacagcattgtcctctagctccataaatacactttcagcttcttacatgacatactgtattctgagcgcttttcacataactcacgccgccccaacctcttcccggctgcaggccttggcctgagtcaggaacagggcaaggcagtctgacgagggcccagtttctggacaaaagaggaacagaactttcaggatgggagaactatgaatgagaacgcctgcgcctccctccatcctcgcaataaatcctggaaaggcagt

SEQ ID NO: 2253 - DNA, 50350 bp, Homo sapiens; identical to SEQ ID NO: 2251

SEQ ID NO: 2254 - DNA, 665471 bp, Homo sapiens
tttattttttttaattttatactaagcttttggctatgtcctttcaaagaggtctcccttatctcaagtagtatttattctccacacctaatccagcttcttatcatcatttcaccttattttttaataactctcacagtctgaagttatatttatcatgtagttgtttatttattcggtcctctattataggaatgtaagtaacttgaaggaaattacactgttggtcttgttcatgtgtctactcccagtgccaaaagcagttcctagcatgtttttgaaatgcaataaaatattcactatgcaaatgaaaactgatttttttttgagaggggcagtgtctgccttaaataatacctcattctggaaaacacaattaattatggtagaaactggagagaaatttttttcttatggagaagaaagccctcaaatccccaaatggaggcatagaaaagctgagaaataagttcacatataagcttaggtctgcatttcttgcaaataatattctaataatgtgctctgaaataaacaaaaaagtttcagataaacttttattaatattttgtttagctccatagtttataattgatctatggtttataattgatctatttaaaagatctatttatacttaggctaacacaaacattcaagagctaaatcattgccaagggtatataatgtctacaacctaaatgtagtggctctgacacacacataacaacaacaacaaaaagactatttgctgataggttgaaaagaaataaagaaaaaaatcagttattgtggttatttagtcaaagaggaaagcaaaactgagattgacatagcatatcaactactctgtactcactgtgcatggggtctgcatccatggctccccatcaatttgcattggcagagacttgctcgtcctgggggaaaatatttcattgtaagtattgcaaggaaatactttatattacagactatatgtgagatataagatgatgagaccagggaaggcaatatggtaatagttgggctctaaatttatctccaatgaaaggagcttcaactctccactattaataaataccctgaaaagtaccttagtcacaggaatattatgagcttcctggtaagtgtagtgacatttaaaaaaattctggatgccaaaagaaaaatttcagggtttatgtttaatgacacgatcagaatttctacagccaaaagagattccttgtttttataaccctacattgcaaactgggagaaaggtgtttctcccagttcttctagcaccaacacttccagataaataacatcaattattcctgtgctacaatccgtggcttcacctgggcagatcacgaggtcagtagtttgaaaccagcctgaccaacatggtgaaaccccatctgtactaaaaatacaaaaattagccaggatgtgttggcgggtgcctgtaatcccagatactcgggaggatgaggcagaagaatccttgaaactggaaggtggggttgcagtgagccaagatcgtgccactgcactccagcctgggcaacaagagtgaaactccgtctcaaaaaaaaaaaaaaaaaaaaaaaaaattggggggaaattttgggcaaaaaaaatgcttgaaaaagttaaaatttaaaacatatataaaatcttactgtggcactttagtccatgaaatgatttaagtcaatggtgtctcatcattgttttcatagataatttgcccagtaaatactttggtgcttcagtagactaatatgagtataaatcataaaatttgtatgtttgaattcgtgcatcaatatgtccatggtagtcaacaagagagaatcagattccaacaaaccatatcagtaatagctaaccaatattttagacaatctgccaatgtccattattttgaaatatattagtattaataactgattatttggagcccaaagaagacaatgttactatcagagttctgcatacttttaattagtttgaggctatgccatatcaaacgcctttgtcagttacagaaagggaactacctgatgaccacgcaggagcactgagccagccgccggccagcacttttcaggcctgtgtatatttgccccatctccatggctccttccaagccgaccacctccagcagctggtcactgagatctgaaagaaagtagatgccttttaagttgcaatgtgtatacatatgtccacaatttaatgccatttgatattatggagattaaaaaaaataacagccacttcacaaagaaagcttgtcttagaaacttaaagtaataaaaagatggcctacttttataactctcagtttaactaaaccttgaggttctgtggaaaatgatttgctgtcagcttattctaaaacaaaatgggaagcacagattctgagccaaataataccaaaaaaaaaaaaaaaaaacccagtagtttttaacatcaacaaacttaatgttattccacatgtatataaggaccatttatacatcccacatcagacatttggcagcaaatacacatttcaacactataaataaaatatgaggatatgctgtcaaacatgattttgttaaattacttgaacaagagaccttggagatcatggagttggagcttctcattttatacattagaagatgggagtccctaaatctttgagtaacttgtctgtagtaataggtaactgtacagaagttcaagaaacaatagtaattttgtgaaatgtttttccgatgttaaggaatattctacaaaatactgtttggtagtatactagataattagtcccatgcaatcattattattaaatttttttttagcagaagacattaaaaaggggctaatagttaagagttgtcgcttgttgagtatttactaggactaattactttatattatctcatttgctcctgctccagaccaatttaagataaatgtgattctcctcatttacagatagagaagctaaacattggagatgttaataattattcatattcacatacctagaaagtgacagagccaaaaagtgaacctaattgctttgatgcactatgctacatttgataaatcaatcatatgaaaaggacagaatttacaacgttttagaaatcatcttaacataaaggtggaggttggactgcgtgagcttcaaggttcctttccaatctgaatatttgcattcagccagaaagcagaagttgaactcacatcaatagaatcccacacagtcctgtcccaagactcagtgacagcccatctgctcacctatttaactcagagtgctgagacccttgatttggaggccaaagtctaggtgcatatatatggttcttttccattgtaatattcttatgtgtttttgtgtattttcaaatataaatacacaattgtacattgtttagtagcagaaaaactagaggagtggaatacggtgggaggcatgattattatacaagaaagccatgtaatagttggtcatatttgaggtcggactcatagaaaaacaagcaaatgtgttttgtagggaatccactttgtacagaaagtgctcactcctcactaatgactccattttagcatagagtttagagatgctaatgatttattttcagtgtagttcaactgtgtggcagcaaatagtgctttgcaatctccaagttcgttaagcccaggatcgtaggtaaatttaataaaagcactttaaaaagaatatgcaaccaagccaccaaacttttaagtgaataataaaaatctattatttttaactttaagctgtagctgtagcaccggattactccaagtaaaaacaatattttagctacaaaatcaaatgttaacttagagcttccaccttgctgttctaaaccccatttagacttatttctcatgaaacttattctgtgtttctagtttaaattcatgttgccaagaacagatggacaaggaatggaaacatattctttcagctgtagccggcactaaaatgtgcttggctctatagcctgggtgttaatatacgcatttcttagatatatgtcaaccagaaaacgacattgtggcaagcactgaagccccagatgtgtgcctgctgatatttataaaacaacaactaccaccacgatgatcaccaccaccacaggactggagttcgcatttagtattgtagattttgcacggcctgattcctaaataggtagaattctgtgttaatttctgcaatgatctgaaactggttgatgggaaccattctataagaaatgaaacactttctcaagacagagttaatctgtgagccctaactttttcatgaatcacagggatctgtctacacccacaccatattgctactgtctaccaccctccttctgatttttttctttcttttaatttgtctttgtttttctgcatgcaaaaatgccttgaaaatcaattctgctgttaataatcagtaatgaagatatttctcatagacttagaacacccaggcttttaaactttcatgttcttgctaacacaaataattttataggaatagtgccatctttactaactctagcaaaggcaaataaataccatactccttttaattaggcattcagggagagaaaacaaaaacaaaatgaaactctaaatttgtgttgcacgaatttgcccccataacacttccacattttttgatacagcacaatctgcaatctgtctgtatacaattgatgccccctacctgttaatctttgagatcagggtcctgattgatttcagacagagagagtttctatctatgcaattttgaattctgtttctatatgtggtatcctttggaacatcagacttcctcacctcacattctagctaagagttattttaagaacagttctccttgggatggcctaaccagctagatcaacctatttaattggtttgctacctggctgctggcttcatatttaagagtgtgagcagcaaaagatggcctatggaccaaatctggcccctagccctttttgtatggctcacaacaattaagaatggttttatatatttaaaaatataaaaaaataaagtactataacatctgaaaattatataaaattcaaatttcagtgcccatcaattagtcttcattggaacacagccacattcactggtttaggtcttgtctatgtctctttttgtactacagaggcacagtagagaccatatggtcgacaaagctgaaaatatttactatgtggacctttagataagtttgcccacctatgctttagagaaacatgaacactttcaggtcactaaggttgtcactttagtactgcagctataaatgctaaatggcaatttattttttagtgcctgaaagacataatgttccagcattaattccacagtgtatgtaaccatgcatagaacagctgttctccaccagggagtctcaccacacttgtgtactatgagcattgccacaatccattggttatttatcacggaacaccaaaagtttccaaataattttattacaaaagaaagtagaacagtttaacattcattagtgtgctcaatcattgcctctggttggcttccttgagtgtgagaaaaagaagaatcatagataggaaggcagaagttgcaaccagacctggagattcaggtgggaaacagctctaccttcaaaagttaagtgtcaagaactgtgaaatcctgacaccatgatactgaaatccatttgtgtctatctagaggaagacgttgcttttgttcagtttaatgttataaagtatacttttgaaggaaaacaaagtacgtttctgaaagcatttatatgtctttttaaatacctccatgggagtaaacagagacaagctttcatattaggtattttcacatttaaaacagaacatctataaaaggtatttcagagggaagaaacttaataaaatcatcaaaattgggtcatattggatcaagattcttaacacatggtctgtgaatctgaataggaaaaatgcaactttattttcactaacatgtaattgaaattaagcatttctttcaaatataaatgtagtcaggaatacctgtgactttgtcactgataaatatcacgttatagttgttacaatatttcctactttaagaaaagataatacgttttaattatccacaataccaaaatatctacaagtctctataaaataaaataacacattaaattttattttttttatttttatcttatgtaatttttcaaaatgttatttatattcattatgtcaaattttaataattattgaacttctagattttaatttgttaataagaaagcatatatatctctaaatcaaaatttctaacagcattttaatctaatttttcatagaaaagcatatatatctctaaatcaaaattttaacagtattttaatataactgactcccttttttagcctacgtattttatcttataaattttaaaacattatgtctgagaagagtcagtagatttcaccagacaggcaaaaagactatagcacaaaaatggtaaggaaccctactttagaatggaatttgtcattttaaagtttataaatctttataaactttataaatctgtgaaaataattagtgctgcattcatctgttacacaggtaatcagggatatgaatgtaaatttgaaagtcaggggcacatatagattagaggacacacgagcagctcagctaataagtgggtaatatttattcatagcttagtcttcatttttgacagttatgccctgataatatgtctcattatgtaattgtttcagactgccatatgtgaagaaacagaagagaatgcattacaaacacagaatgaatgtgggttgtagcatttcgcagaatatagtgggtactgaagaaagggggagaaaggctggagcagagtagtataaacccctttgtgcagagtgtccagcaacattctgcaccactgtcagaggccatgtggaggtactcattgactcagcaggagcattttgaaatcaacataaattgctaattataatgacacttattgagccattatttggccatagtaagaccaggctagctatggagttgtaccttttgagtgtttgtagattgtatgccttccagtgatgtttcatttatctagcaacattatgaaacatgtctgaggaccaagaataaacttttaaaaggccaaggaacatatgaaatccattcactagagtgaataattcaatgattcgtcttcaaaatgtccatctacttctaattgattcttaatttagatatacttctcacaagcataaatgcctgtttttcctgacctacataacccagaagacataaattttaaaagggggtgggtaggaagagttttagcaaaaatttattaatataaactgtgtttcagagtacaagtatgtaaaacataaaggcaggctttttgcacctgaaggaacatacaatccaattgtaggtctattaataaaggagaaactgtatggggaaggctaatatatctactatatgcctgctatgagcaggctccctgctaagggatttataggcatttttccatttaagactctcaacagtcctttgagataggtattattctcctcattttattgacagggaaactatgtcacttgttcaagtctttacatagaattgaaaatctggttttctaaataggtatgcttgactctaaattccatgttactgtgacaacagtaagaactaaccaattaaatgttaacagttctcttggatcatcatggcggacaggaggcaggactagattgcagctccagacagagcagctcgcattgtaaattttagctcaatagattgcaagaacaaaccagcaatctcgagaggacacacagacgctctgacggaagtggactgctcctgcggagcctgggagaccccccaaatactgagtgcccaactgaggaagtggaaaagggagaccctcctctccccatcacatgcccccactagagaagctgacagtccatttgcaggagaagtttccggctttacttggagctgagtcaatttggaaagctaagccaagtacaggggtagaggaagcagcagaaaggccctgggagctcctggagtcccctaactggccgttcctgcctggcaccataccacagggatccaacgggagggtgaccagaggagcagggggtaaaactccacagggagaaggaaatctctagctaaactttgtaacaatttgaacggggtgggaagccacctggctagaactcaggagagggcgcaaatctggtgtgcaaactccacaggcaggggaagaaccaagaccttttctttcgcagttgggaggtgagttttcaggccggtctcaccttctgcctggaaactaactcgggtctgttcgtgggggcacggtgagagttagaacgggccttcagtttgcatgggagctgtgtgaggcctgtgactgtgggctttcccccacttccctgacaacctgcatgactcagcagaggcagccataatcctcctaggtatacaagtccagggacctgcaaatctcatccccatcccccatgctgcagctgcagcaagacccacccaaggagagtctgagctcagaaatgcctaaccctgccctcctcctgattgtctttccctactcaccctggtagtggaagacaaagggcatataatcttgggagttctagggcctcgcccactgccagttcctctctggaaagcaccacctcctggcaggaggtgcaaaaaaagcattggattaaatccagcgtctctttatgattaaagctctcagcaaaatcggtatgcaagggacataccttaatgtaataaaagccatctattacaaactcacagccaacataatactgaatggggagaagttgaaagcattccctctgagaactggaacaagacaaggatgcccactctcaccactactcttcaacatagtactggaagtcctagttagaacaatcagactagagaaagaagtaaagggcatccaaatcggtaaagaggaagtaaaactgtcactgtttgctgatgatataatcttttactttgaaaaccctaaggactcctccagaaagctcctagaattgataaaagaattcagtttccagatgcaggattaatgtacacaaatcagtagctcttgtacacaataatggcgaccaagtggagaatcaaataaagaactcaaccacttttacaatagctgcaaaacaaacatcttaggaatatacctaaccaaggagtcgaaagacctctacaaggaaaactgcaaaacgctattgaaaaaaatcatagatgacatgaacaaatggaaacacattccatgctcatggatgggtagaatcaatattgtgaaaatgaccatactgccaaaagcaatctacaattcaatgcaattcccatcaaaataccacaccatcattcttcacagaattagaaaaaaaaattctaaaaatcatatagaaccaaaaaagagcccacatagacaaagcaagactaagcaaaaagaacaaatctggaagcatcacattacctgattttaaactatactgtaaggccatagtcaccaaaacagaatggtactggtacaaaaacaggcacatagaccaatggaacagaatagagaacccagaaataaacccaaatactacagccaactgatctttgacaaaacaaacaaaaacataaagtgggggaaaggacaccctttttaacaaatggtgctgggataattggctagccacatctagaagaataaaactggatccttatctctcaccttatacaaaaatcaattcaagatggattaaggacttaaacctaagacctgaaactataaaaattctagaagataacattggaaaaactctcctagacattggcttaggcaaggatttcatgaccaagaacccaaaagcaaatgcaataaaaacaaagataagtagctgggacctaattaaactaaagagcttttgcatggcaaaaggaacagtcagcagagtaaacagacaacccacaaagtgggagataatcttcacaatccatacatctgacaaaggactaataaccagaatctacaagaaactcaaacaaattggtaagaaaaaatcaatcccatcaaaaagtgggctaaggacatgaatagacaatcctcaaaagaagatatacaaatggccaacaaacatatgaaaaatgctcatcattactaatgatcaggaaatgcaaatcaaaactacactgctataccaccttattcctgcaagaatgaccataatcaaaaaaataatcaaaaaacagtagatgttggtgtgtatgtggtgaatagagaacaattctacactgtgggtgggaatgtaaactagcacagccactataaaaaaacagtgtggagattccttaaagaactaaaagtagaactaccatttgatctagcagtccctctactgggtgtctacacaaaggaaaagaagtcattattcagaaaagatacttgcacatgcatgtttatagcagcacaattcacaattgcaaaattgtggaaccaacccaaatgcccatcaatcaaagagtggataaagaaactgtggtatatatattcaatgtaatactacacagacataaaaaagaatgaattaacagcatttgcagtgccctggatgagactggagactattattctaagtgaaataactcaggaatggaaaaccaaacgtcgtatgttctcatggatatgtgggagataagctatgaggaagcaaaggcataaggatgatacagtagactttggggacttggggggaagagttggagaggggcgagggataaaagactacaaatatagtgagtgtatactgctcaggtgatgggtgcaccaaaatgtcacaaataaccactaaaaaacttactcatgtaaccaaatatcacctgtatcccaataacttatggaaaaataaataaataaataaataaatgttatcagtgatggaagagaaaaaagtgctacaaaggaatacatacataacaccttaaaatagtccagcaaacagtcctaccaataaatcatttcaaatgtaatcacaaaattaaaatgaagtacaaagctcccatttataataccatgtggggtaatgtatgaagaatactctggagaagctcagtaagaaagctaagagcctggccctgctgtactcacatgcacctctgcctggcccaacatctggttcagcagcagacaaacctccctggacagatagccacaggcctgcttggcatcaccacacctgcacacacctgagcccagcctgacagccagtctgggtggtcccatttccctgcaaataccattgcaggaatgcctggcaccattgctctcatgcttggtccaacagctggtccagtgataattctgctttcctagacagattgccacagagtccaacaaccagcctagcgctcctgtcctcagcaaaactacactgctgccatcacaaacgcctgcagcctagagcactgaggcaatatatatcactgatgaggattacagctgaagaaactgcatgaagactacagtactgagtcgacctagagctaaagccaatgcaccacatttaacactaggacttgtttacaggaaaacatttatccctacaaaagctactccataatgttggaaaaaattgactacacaattagattcacagatataaatgtagggacacaagaaacataaaaaagcaaattaacatggcacccacaaaatgtctccagtaacagactcccaaaaaggacattcatataatatctgaaaaataaattcaaaattatgattttaaggaaactgagcaagatataagagaacacagagaaacaattcaataaaatcaggaaaacaattcatgatccgaatgagaaattcaacaaagatgtatataaaataaaaaaagaaccaagcggaattggagcagaaatattcaatgaatgaaatgaaaaaaatacataactgacagcttcaacaacagacaagatgaaggagaagaaagaatttatgaacttgaagacagatcttttgaaatagcccagccagaggaggggaaaagaaagtagaaataagaaaaatagagaatgaagaaagcctacaggacttatgggacaccatcaagtgaataaattttctcataataggagtgtcagagggaaagagacggagaaaagcacagaaaatttatttaacgaaataatagctgaaaaattcccaagtattggtagagttatgaacatccagattgaggaagttaaaagatccccaattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagcctagatcccgccactgcactccagcctgggcgacaaagcgagactccgtctcaaaaaaaaaaaaaaaaaaaaaaaaaagatccccaattacattcaatccaaaaaattctctctgaggcatattataatcaaaccgtcaaaagtcaaagacaatgaaataattctaaaatctacaaaagaaaagtatcaagtctcttataagggaatctgcatcacactattagcagatttctcagcagaaaccttaaagctggtagagaatgggatgatatattcaaagtgctgaaagaaaaaaaagctgtcagttgagaatattatataaagcaaagatatttttccagaaatgaagaagaaataaaaatttttgcagataagaaaaagctaagggaattcattaccataaagttggtgttacaagaaacacttgagagtgctacaaatggaaacaaaaggaccataattactaacaggaaaacaagtgaaagtataaaactcaccgtagagtaagttaattaatcaaattcctaatatttccagtgatatgatacgtctttcaatcctctagtatgaacgtttaatgtcaaatggtcaaaaccaagaattacaattaatggcaaaggaacacaccacagataaagaagtaaattaagtgaacaaaagtataaattttagggggaaggaaaactgtctagagtaattttatgcaaccaaagttaagttgccatcatcttaaaatagtcaattctaactacaagactctttatgttagcctgtggtaatcacaaacaaataatgtactgcagacaatcaaatgagaatgagaaaataaagcttagcaccacagaaaaccaccaaaccacagaggtaaatagcaagagaagaagaaagaaataaggaatctacaagataaggaaaaaataatgaacaaaatggcagaagtacttatctaacaataataaccttgaatgtaaatggattaaattttcccattaagagacagaatggctgaataggcaaaataaaataaaataagacccaactatatactacctaaaaaagattcacctcaaaaaaggcaggctgaaagcaaagggatagaaaaagatattccgtgcaaacaaaaacaaaaattgaacagaataagccatattgatatcagataaaagatattttaagtcaaaaactgttaaaagaggcagagaatgttattatatataatgagaaagggatcaattcaacaagaggatataacaattgtaaatatatatgcaaccaacacaaaagcactcaaatatatagagcaaccgttattagatctaaagggagagatagaacacaatacaaaatagtaggggattacacccactttcaacaagggtaagctaatgacaaaaaatcaacaaagaaacattggacttacactgcaccatagaccaaatggacctaacagacatttacagaacatttcatccaacagctttagaatacatattcttttcggttgcacatggaacgttctccaggatgaatcacatattaggccacaaaataaatctcaacaaatgtaagaagagatgatcagctatcttttcgggccattatggtctaaactagaaattaacaaaataaaattttggaaatgttacaaatagatggaagttaaacaacatccttttagataaccaatgggtcagtgagtaagttaaaagaaaattaaaattttcttgagacaaatgagaatgggacacatcttaccaaaacccatgggacacaataaaaccagtactaaaagggaaatttatagtaataattgtctacatcacaaaagaagatttctatgaaacaatccaacaatgcatctcaaaggcctaggatttgttattaatttaataataaactaaagccaaaattagcagaaggaaggaaataataaaactcagagcagaaataaacaaaattgatgctaagaacaaaaattcaaaagatcaacaaaatgaagaatttgtttttttgaaatgataaaggaaaatcaataaaccacaagctaggctaactaaaaaaaagaaagaagactcaaaaaaataaaatcaaggatgaagtaggagatattaaagctgataccaacttttttttgcaatacgtttgcagctagaacaccagtgtcatgaaaaccatccctaaagtcaaatgggaaagaaaagaaaaagactcccatcaacattgtcaaaattggacacattgattcaggcaagtccaccactactggccatttgatctacagatgtggtgggattgaccaaagaaccatcgaaaattttgaggaagaggctgttgagataagaaagagttacttcaagtatgcctgggtcttagataaactgaaagccgaacctgaacatggtatcaccattgataccctgtggaaatttgagaccagcagttactacttgattattattgatagtctgggacacagatgctttgcgaaaaacgtgaatacagccacatttcaggctgactgtgatgtcctgattgttgctgctggtgctggtgaatttgaactggtgtctccaggaatgaacagacgtatgagcatgcatttctggtttacacactgggtgtgaaacagttattgttaacaaaatggattccacttagccactctatagccagaaaaggtacaaagaatcattgagaaagctgaaacttaagaaaattggctacaatgccaacacagtaacatctgtgccaatttctggttggaattgtgacaatatgctagagccatgtgctaacatgcattggttcaagggatggaaaatcacctgtaaagatggcaatgccagtggaactatgttgcttgaaactctgcaatgcatcctatcaccaactcatccaactgacaagcccttatttgtggtctgcctctccaggatttctacagaattggtgattttgatactgttactgtgttctgagtggtgactgggttacctttgctccagtcaatgttacaactgaagaaaagtctgttgaaatgcaccatgaggctttgagcgaaactcttctgggggacaaagggggcttcaatgtcaaggatgtgcacgtcaaagatgttcactgtgccaacattgctgatgacagcaaaaatgacccaccaatggaaacaaatggctttcctactcaggtgactattctgcaccaaacaggctaaatcagtgacggctatgtccctgtactggattgtcacacagttcacattgcttgccagtttgctgagctgaaggaaaagattgattgccagtctggtaaaaagctggaagatggccctaaatacttgaagtctggtgatgctaccattgtcgatatggttcctggcaagctcctgtgttgagagcttttctgactatcctctgagtcattttgctatttgttctatgagacagatagtcgctgtgggtgtcatcaaagcagtggacaggaaggctgctgatggtggaaaggtcaccagagttggtgaggaagaaataaaaggcatccaaactgggaagaaggtagtcaaattgtccctatttgtagatgttataatattttacataaagaaaactctaaagactccaccaaaaactagtcaaactgaaaaacaaattcactaaaattgcaggatacaaaatcaacatacacaaatcagtagcatgtccataggataatagtgaactcgctgaaaaagaatttttaaaactttcttttaccatagctacaaaaaaactagatacctaggaatatatttaaccaaggaggtgaaagatctctacaataaaactgtaaaactttgatgaaaaataaatggaagaggacacaaataaatggaaagacatattatattcatgaattggaagaattttttttaaatggtcatagtacccaaagtgatctgcagatttaatgcaattcctgtcaaaataactataatattcttcagagcagcggtcctcaatgtttttggcaccagggactggttcatggatgacagtttttccacagaccagccacagggttgggaggtggttttgagatgatccaagtgcattacatttattgtgcactttatattattagcactttatttatattattacattgtaatatatagttatatattatttcattatgtattacaatgtaataatacaactcactataatgttgagtcagtgggacccctaagcttgttttcctgcaactagatgataccatctaggggtgatgggaaacactgacagatcatcaggtgttagattcacatacagagtgctcaacctaggtcccttgcatgcgcagttcacaatagggtttgcactcctatgagaatctaatgcagatgctgatttgacaggagtctgagctcaggcggtaatgcgagtgatggggagcagctataaaatacagatgaagcttcactctcacctgctgctcacctcctgctacgcgacccagttcctaataggccacagacccatacgcctgtttgtggcctgggggttagggacccctgcttcagagaaatagaaaaaaaaaaaaacaactataaaattctgtagaactacaaaataccctaaatagccaaagacatactgagcaaaaagaacaaagtggaagggatcacaccacctgacttcaaaatacactattatacaaagatatagtaaccaaaacaacatggcgctggcacagaaacagacacatagactaatagaatagaatggagagaccagaaatacattcaacacctacagccaactgatttttgacaaagatgccaaaaacacacattggggaaaaagtagtctcttcaataaatggtgctaggaaaattcaataatcacatgcaaaagaatgagactagaccctgactcatgttatgtacaaaaatcaactcaaaatgaattaaagatttaaatgtaaagtttgaaactatgaaacaactagaagaaatcacagagaaaatgctttatgacgttagggtgggcaaggactttttaaataagatctcaaaagcacagacaacgaaagcaaaaagagacaaatggagtttcattgaactaaaaagcttttgaagaggaaactattcacagagtaaagagataacctagcaaatgggagaaaatatatgtagactatacttctaacaaggagttaatatatagaatatataaaggaacacaaacaactcaatgggaaaaaaacccccaaatacctcattttaaaaatgggcaaaagactttaatagacattctcaaaagaagacatacaaatggccattagttatatgaaaaaaatgctcaataccactaatcataaaggaaatgtaaatgaaaaccacaacgagatgttacttcattccaattagactggtggttatcagaaagacaaaagaaatcaagtgctggtaaggttgtggagaaatgggaacacttatatgctgttggtagcaatatatactagtacaaccattatggaaaacagtatggaggttccccaaaaatagtcaaaatagaattaacatgtgatctagcaattccactactggatgtatagccaaaggaaatggaatcagcacgtcaaaagagatatctgtactctcaacttctgtagcactatttataatagctaatatattgaatcgacctaagtgtccaacagtggatgaatggataaaaaatgtggcaaatatacaccgtagaatattattcagccataaaaagaataaaatcctgtcatttgtgacaacatggatgaacctggaggacaccgtgttaaccgaaataagccagacacagaatgataaataccacattatctcactcatttttagatgtggaatagtaaaaataatttttaaatataacaagaagataagaatctggtacataaatggattaacaagagtcatttaaaaaatctagcagtgtgaaatgttgcattccctgttgaaatctaaaaatgaggggttaatatatgttatattatgttatatatgtatgcagaaatacatatattctgttatatatgtacacagaaatacatatatattcatagtggaagcctgactttaaaaagaacttttcaagaatggatttgatcatctcttttaaagccatctagtttttgaaaacaaccagccggagctgactataactttgtttttatgctaaaattctgaactcctttaaacgagtctaaaataaggaaagaccagaaatcacagtacagcatattgtcaacaacctctctatagcgaccaaaggagttcagggcctgcaagtcactgtgttatagtgtacttgaaaagtcatctacaccacaggaacgcaaccaaataaataagtatttcaccgacaaaacccatagagaaagagtttaaagacttcccacagcaatccattgctgccactagccatgtgtattatcagtaaatgtaaatggtgtaaactagtggtgaatatgaacactgctgcttctgggttcttgaagcagtttgttctcgttaagctttgtgaagggactgaaggctttcacttgttttctgtgtgaatgagccgttagtgtgtgtgggaatgttttcacagcaccatgcctcttctgcccttttctataaactgagctacttcacgtgtctcctcatattagtgccatcactaaacaaagcaagcgctcatgaatgaaggctgatgtcagcaaattctgaatagcttctggaggggcatcctgcaccctaacactgatgccagctaaggggatgaagtcaccagggagatcacccactcttattctcctaagaactgagcagttccagcaatgaaaagcaatacaaagcaaacaaacaaatattcagattaaaatgcaatgtaatacagggcagtgccaacattactttacatatgactacacggtctttacactaaatatccagaagtactgtgaaaatcagttattttcttgagatatattataaactataatgagatgtttctatggtccctttattttagtttcagtgaaacatgaaaaacacataaaaataaaattttagaaacatggtagtacatttgaactcacttataaacttaataatgctgaacattaaaataaggacagaacatgatgatgaggaaaagtgatttacagtaaacatttccttgtaaaacagaactgtttctggtatccaatttaccctggttgcatgtaagtcttacgtgcttagcaagagattgaaagactttataatatttgaggttattgtgcataaaaccattgctggtcagaagtaaatcttactgtcttggcagtttgtcttcagagaataggcgacatgtctaaatagaattaaatctcagcaaccttcatgtagaactgtttgttgccgaaaaatataggattatatcatgacgtctggtgacttgccagagaacccttgaaaccctgctgagttcaaggctctgcacaacaggaatgtcatagtttctgcttagaacagtgtgtgtatttaaggagttttgctgttaatgcaggactaaggacccctcactcatgaactgagacagggactgttattgtcgaaagcactaaacacactttcctcattgcctcaccatttaaagatgagcagtttttgactcatgcctcaaagaaagaattattctagtcataaaagcctgctaaagttttcttttttaaagcttataaacagactgcgggcagattgaccatcatatctaataagctaactgttaacaagttagtacagtttagtatacacctgaatacttctattttctatatttttctcctccccccacactccctttcttttgaagtaattttatttcatgaccttatgtctacagaaaaagaattatattactgtcttggattactaaattgaattaatgttgacataaatagttttatttggatggaattttaaaattaattccatttgtaaataaccataagaaatacaatctcctttgtcatttcgatcacaaagtagcagagaaatctattccacacataaaatcacttagaagagagaacttgcaacttactacagtataagagattttcagtatctagtcaccttatgactcatattaatcatgtactgacaagtttccaaagagcttgaattaaaaaaaaaataagcccttgtatatagacatgttgaaggacttagataagtacaaaaaatctctgtgaaaaagttttcattgatgttttaaaaagcgtgttattttatctttacaaaggaactgcactaacactaatctagcttttggaaaatacagcaacattcatgactaatcgtagtgtgaaaagtagaaatggacatgaaaagtatcatcacctctagcaacacttgaaaccctaagagaggttcaaatgcaaactttcagattttcaacactgaaaaaccaaggactttatcttccctttcaaggagttgctttgtggggcgggggaaaccaaaacctcttttgtagtacaaactttgccaatatatctgattctttttctacctcctcttagaagagatataccccctttttaatagtttaaaaatactattgcagtgaaactcttggtacaaaggaaaattattctatttagtcgtattcttttaaaagttatttgtttaaaagggcttcactgtattggtcttgcagcccttcatacaacagaacaaaagcagttctatgaaagaagactaaacttgaacaaaccgtaaaaaaaaaaagcaaagttcctctctgtttttatcaaatttgattgctgcagctgttcccagtttctgtattttaaaaatagccttattcagtgccttgttggctaaaggccagagtgccattagaacatgctgtacggaaaacctctattcagttacagatacagaaatatatttaagatcagtgggggtcatctgcagcaaacacttgtaaaggaaaatcgaattttaatgtgtttggactgattgccacttttaccagatagtttaaagcttccatatagaaccatcctattattttttcttttaggtaaaaatgcaaaatgcgtatgaacttcattggacaaatattattagaaaggtctgtttctcaaataacaattgtacagctgagatacacatttcaaagaatacctactagtggtttctgtttgacaagctcacaggcattcatcgagtgaaaaggtaggtaatattgagcaaatgctacaaatggaatcataacttctttctgacacagtcctcctaagtaaggtcacgaggtgtgaaatagattgatctgcccaagggaaatgagtctggggactcattttggacttaaagtgtgtggggaaagggtgaaagaattgagttattcagtgatgtttcagagttgaccttcacatctcttcagttctttcctttgcctcagcaaaggattgaaattagcatttgggactaaacagattcctgtaggagtcctaatttgagttgtaagtaaaaaggatctgcttcgcataaatcatcaataaaaaggaattttgattccaggtattgaaaatagtaagaaaaaattagaaagcagaggtctagggaaaactaaggtgagaagaaaaaatttcattagggaaatatacagcagttgtcaaggtatgggaacatctaagatttcacctttcttgaaagctaacatgttagcctgccacagctttgttgaggctggcagaagacatgagttccctgcatcagagacccaagacgttactatccacagcaacagcagtcaccagtcttaacatctaaatcagtcccccaaaccccaacttccatagggtgaaacaaagaggtctgggagatacctgcacacataatgggctgcattatagaagagaaacccatggcttacaataccttgatctttcataatagaaaataagcctgcctgatctcttcccagctgccaaactggctaaaaaatgaagctcttattgacatttttatggttatatgtgaattgctaccatgatggtattaaaatagaagagatatcaaaatatttcacaatcagcaagagtactggccacagtgtatcctagatattgtaagaaaatagggtcccagaggtctctaaggtacctggcattgatactttaaatgttggatttggaaaagtctgggaggtcatgaggagggatagggggaacctggaaggacagggcgaactgtgcagaaatatttaaataatttaacatttggtacagctatgctgaaggtcccagtggaaggtactaaactgaaatatgtctcagaagttctgattcctagtcctaaattttgatttagctaaagggcaacttcaggtaagtcatttaatgtttctgggacccagttaccctatctctaaaagagaaatggtactgaccttagattgtgattaaatatattgttccaatcagttacatagtaatttttttgctcattctctttctcccctacactaaataaactttatgtataagtaataaaattataaattctgtggctattccacttttgatagacaaaaatttccacgagaatagcttgaaaaatattggaagtgaagtaattgagcgtgatgggtctcagatgaaagacatttggctacaaatattaaagtggtggggggaatacagaatgaataggaaaaaggaatagaaaaacaaaagaacagcaaataaaaatgtctgatctaagaaagcatttggatcagatgaatgggaaatgtaattaggctggacacctccggaaagggcaaaaatatgagcatttccaccatgaaatcaaagtaagatagagtaactaggtcagcactctgcaggcggcctgggacaggactgggctcactgtgaacttagaagcagaaataaaatccacatggtcacatttccacaaggaatggaacaaatagatgatgcccaggtgttctaggcataaggcattgtagagcaaaaagttcagtgggattcaattagtaagtagaacaaagcttcactataactgggcaagtggcagtgcactataatgaagctcttaattaggctaataatttaatataagtatgttactatgttattgctttaagatttctgaaataaaaggagtagtgacaacgaagtatacaatttcttagctttctggataacaatattgcaaagcaagatatttgttatttagcaaatacttactacaatgtcagaaattatgaaaacaaggatcaaaacaaacaaacaaacaaaaacaaaatctagctcctgagtatatagtggtgtacagggcacaaaaagagacctttactacaataattgacaaggagatgttcagatttcactccaggttcagagctggcctttaagtctagaacttctggaggccaacatgccactgcatagaggtcattctggttaataaattgagcacaaggattcacccattcctgaatctagttctttaaagttgtttagtaacaattctcctttaatactttctcttatgttgccagtcctctgctaaatgttataaaaacacaatatgtttatgactcttttgtactcaacctatactatgaggcagcaatgagagaatcaaaaaattacatggtgtggcccccagagtgcaagacctagcagttaaaaaatgatacctatcactgtgcactttggctacctcattacctagtgagacaactcctcattgttgagcataatcactaggaatattttagtgcaactcatgtattccccacattacccacaaaagccgtcctcatttttacacaggtgttatgaatttctaattgtctctttttgtttcttcttgattaggaatttggcaagaatttttattttcctggcttacattttatctcaatgtttattttcttatacatattgtttcataatactacatatgatttctttgcccatttatccatttacctcatccaacaaagttacattgagcaccaacagatgcttagtagatcaatgtatgccaggtactctggaatgtgactgagatagatgtaaaaagctattagtctccttaagagcactaacatgtaaaaaaaacgtaatgtagcattgtcaaaaagggagagtgtttaactctatggaggatggttggtggtggggagagagttgggattgtagaagcttaggaaaagcctaaaaagttgtgagaaattaggtaatgaagattcagtcatgaagggcctgagagcttgggttttccttacatttgactagggtgtagttaaaaattctaagctaagtagagaggcagttagatcacattttataaaggacatttagggagttgtggaagatggtttcttcattcatttaggctgctacacaaaaataccataaactggatcgcatataaacaacaatgtatttctcacagttctggaggctggaaatccaacatcaaggcactagcagcgtctggtgagggcctgtttcctagatagctgtcttttcactgtaaccttacaggatggaaggcttgagggatccttgtgtggtccctttttatacaggcattaatcccaattatgatggcaccaccctcataacttaatcaactcccaaaggtctcactcctagtaacatcacctaggggttagaatttcaatatatgaattttgggcagacacaaacattcagaccattgcagatggattcaaaggcaatgaggtaagaaacagcagggtgatcaattagagaagcattgaaataatgctgatgagagatgatagggagttaaagtaagctgtgaccaggtgcatgagagtgaaagttgcttaggaggtagaactgacagcattatgaatagccacctggggagtgtcggaaggcattgcagtggccaccggggttcagggttggtagacaagctgatgatgatgtcaccaactaagatgcaaaatcctgggggaaaagcaagtaggaaagtaggaaacatggtaagtttgattttgcatgtgctggtattgtggactctgtgggacatccacatggagctctctatagagaggacggcctggtgaatatatatctgtagatgtgaacattatttccaaattaattacaaattaaaaaaataagaatcatatatcatgttgctttggagtttgttgttttgtttttagatgtccaaatgcataacctggcacagagcagacaatcaataagcatacgttgaattagtaataatgtattatattaagtacacttgaagctttcctgatagtcttctataagaggctccaataaagggtagactcacctttaaatttggcttacaatgagtactagctaggaacaaaataattgctcatgatttcagagaacacttcttgaagtgacaaatatatttcttttgataaaggtaaccattaatggattatctataatgtgataattgcttcttatatttatctagctctgtttagtttcccattcttttttatgatttaatgtactcatagtatttatatgcttaaaccattgttaactggattttttttctggtaaccaatagcatttcttactgatacaattttacagatggaggaaagaagtcagagaagatgaatggtttgctcacagtaattcagcagtgtctagagttcttcccatgatatcataattcctctcaacatcatgaggctactgatggaaagtgcctttaggtatctgtcattaattactaataacaaggtatttttcaggggcaaaagctgttgttacttagccacactgttgaaaactcctttgccgtgactaactcttgtcaatcctgacagtgattcaagaaaactgttaatttcattatttttatactgactttgctaaagattgaaatcaatttgctacatttttggtatcttttaaatagtataaataaattagaaccaaatctgtaacaatataaaaaaatattatatagaactgcctattaaatgttttgtgttttcaaatatttctaaaaatgattacaatttgatactattattaaaatttaaaattccgtctttgaaacagaagttgtcaggtactgatctgttactgtaagatgccaatcatattatcacatttctagttgctgaagtattttatgaattttgaattctattaaatggtgatttatttttttccagataagtcaccatgcaagaggcacttattacacatgtttttcagcatatgttgcaagtttattttaatgctgaagaggcacattatgatcaaagcagaattctgcccaatttaaactgttccaagctattttcatacattcactcatgtaatactgtaagatttacattaaaatgaatgctcgtctacaattaagcgattcagtcaacattttaaaaaaaggtgcaaatgtgtgcaacgtgaaaaaaaatcaacagatgtgcgaataatctctacttcggggccagtatcaaaaagagcagtagccaaaaaaaaaaaaaaaagttaaaagtttcagcacttatttttcgtctatcctctaaggttttctatacctaagttaaaggacacacacataaaacagtcataagacatttccttatgatgataattggattagtcaataataaattgggttgaggaacaaacaataaactacagtattcacagtagaacttaaagatggatatatattttgttttcttctgattcttatactcttctattctgatgatgaatatattccaaagcagcaatgattcacctctgttcagagaagagtacacatgtaaaaccagaatatttagcactaatgtatttttaaaagatagccagctaggatataataacaaaagcagaaagagcttctgatcctagaggtgaataaatctgcaagccagtgcatgcatgcagttttgcaggttgtataatgcataactgaaggggtcaccattcacattgtggtctaaatgaatggcatcttcttgaattttatagagcacatcctgcacaattataatgtactggggccatggaaaacatcatgagtatgatggaaatgtaaagagtttgttcagataggataactgagatcaaagtgcttcttaaaacctcatctctgttccatgagatatattttggtgaccattggaaggatgtccagttttcacctacttcagtagcagatgtggggcaaagaaaaccttgatgccaattgacagtctgtaatatttagacaatctaaagcttctggtctgataacatggataaaaactactcaaatctcatccctattctctcctcccccagcgaattaattgcaggatatttcttcctttattattttaactgagcttcccagtgacatctatttgagaaaataagaagtggaaatggcactcactgacaagcacattcttagacagggagaaaatgaattggtataattttacttaaaaatattctccattaatgtttttcaacatgattaacatttatgaaaacattgatctatattatagtaaattacatactgtactttaaaatgaggactgtgcttttgtttacaaatttcaacatgctttgctatcctagatgaaatctgaatacatgaaaacttgaggggccttatatatgtacccatgtttaatcctgatgtggcccaaggcttcaactgttctaatttattgcagctcttctacacagttctacaagtagcttggtgagctgacacatttctgtgtctatgtgggttaatctgagcaagaaaatgattagcctgaagtctctggctaaatcactaaccatactttaatccattagatgagaccacctctctacttacattttaaattgggaaacatacaacggctgagaaaacatagggcttatgctttttgatgagctaatatagcctaaattgtcttggtaaactcttcattggccctttgcccatgagaactaaaaggttcaagtgcctagtcaactggctaaaaggaagtttagcatgtttctggaaattacaaaatagccaagacctgtgttgtcacaacagggcagcaaatattctccacattgaaaaagggatgttaaaaacagggccacgagtatgggaagagaacgtacgttcatgtagatcaattctaggggaaaaagaaatgtattactataaattgttggtagttattttctagcaattctttgatatcagggaatgtatttttatttggaaacactttaagcacttgtataagctttcattgtgtgtgtatgtgtccacaactgtagctattcaagaaatatcctatgtttttatcctcttaatcaacttcattcttccttcatgttcccattgctccaacctatcagtaaatctactctcagatatcttacaggcttatttcctctctaaagattgtataacagctaggaaaatgtgaaaatagcctctcatcttagtgtgtcatactgtcactgtgtattcatgtgacacaagcttgcattctgatgccatgtccatgtggggctgaggaaacttgtggagattcatcctgatatctgcctccccggatgcattcacatctctttcaactgataatgtctttccacctcctcaaaactcttccagggagcagctatggttctacattgttcttgagacccacccacagtaaccatcttctctgcttggaccatcagaatctttcctatctcttttcttatgttttaaagcttctctttcttggggacacctcatatcatctcttctgggagcagaagttatacattgttggccagagggttgaatctggttcacagaattgtttggctcataacatattatgttctaaatttttcaacatttgttaaaggttttaaaaaataagtggattctacataaacatgtgattctgagactatcttcaaagattggaggatcagacaacattgggccaacttatcctccttataaaccttttcacctttagacaggacatgctctttccaatcacccaagtccctgcccagtgtgcttcatttctggccccacaaggcatttgtgatttgtcttctgatctctcattctcaactgcttctatgttgtactctgcaaaaaatcacacggccagaatgagggaatgaaccttactacgtatgggaagtagaatcttactatagcttactaaaatagggtggcaaaatacaggcagataggccaaataatatgatatatatatgtatgttatagaagatagatcaattgattgacaggtagatagaagcaagaaaaactatagactttgggtaagatcatttctggtatacaataccaactagttgataattaatttaataatgcacatattcaaaataaaaacttgcatattaactacaaaatgtaaattctcttaaaacttggctttactgaaatgagctatacagacataatatgtgtccttatagagactacagtctatactaagaaagactgtaaagagatgtggaatccacataggaaaatgtgtaattaaaacaccagttgaaaaacatgataggggttatgacagggctaagtccaaggtgatagatagtttgtaggaagaaaaattaaccaaccttaagggaagatttgcctgaggaattcatgtgtaagcaacaactggaagcatgtgagactcatatccaggtgaacaaggaggtgatggtggtttcaggaggagaaacagcaagtgcaaaagtacagcaaaaggtgagatgaaatctagtgcttaaatctacctagaaaccgttcagtatggttgcagcacagaatttcagggcatgtgggagaaaaggcatattaggcttaataaggcaagcaatacctgggcatatgaccttataaatcatgttaaagagtttgaacttacataagggactgtgggtccccactgagatattttttacagtaaacaacataatcagatttttgatgttgagaaatcacatgaacctgctgaaatgtagtttctatacccataaaataggaatagtgtcgtatatcctggttgcctcattggattgctgcaaagatcaaatcaaataatatatgctaaaattcagcaaattctaatatgcaagtaatattataatgcataaagtttatttattgttgcaactattttttgtagaaagtgtgtgagccaatctctgataggctaatagattgtactacatgacaatgagtagtaaagcacaactcatatcagttattagcaaacattctattaagaaatgtgaagaaaacctaagtattagggtaaaaatgtatgagatggaatttataaatgttggcaataacttttaattaatcttttattatactgtttctcttactgggagttgaagaggttgatcatgttttcttgctgcccaacactttttaagcaacttctatgtttcaggaataggaaccctgcctttagagggctacagaagctctctccctctgcctcctttgaggtcaacatgtgatccatcagtatgtgatccatcaacatatgatccgatagcacctgatccctcagactgtaatctatcagagtgtgagtcatcgtgtgtgggatctttcaaagtgtaatctgccaacatatgacctaagctttgccagtcgggtgcattggtgtgagatgtttggaatgcagtggcttgaagagggagataacaggcagaaacagttctggccaggatggcatggagacattctgttctctgagggcatggagtccgaagtcctaggggtagcatcctgtgcccagcttctctgtggtgaggtgttggactcatgcacagaagcagagacattaaggttacctgtgggaatgccaggcaatgtacttggtgagtggttcctggctgtatggcttttaagcctaattatctgtcctttggagagattttgggggtaactaatatcagtaaacatgttccttttctcctcccacaaatgagagtggattctgtggtttacaagtaaaaatcctgactgataaatgtgtcaaaataaaactgttttttcatcttaaggtggcaacctttttttactcctttattgtacttgggaaccagggcacacaaaccatgaggatgagtatataaatgtggaacaaaagaggggaaggaaatggattccaatactctatcttcaaagtgaactaaaaaaatgtaaaatgaataatccccaaaattatatatgacttgtcagcacaatttctcatttgaaccttgaaccagcatctacagaactttgtagatgaacttctatagaagtttgtttgtaaagctctactctatgatattctcagtaaagttttacagtgattaaatatgcaagcttttatatgagttctgggtccagattgttgctccttaagttattaattgtgtgactttgaaaaaagtatttaatctgtataagcacctgtctctccagtaaaataaaacaaaatatccagtgagagagtatattcaacacatttagtgctatgcttggcccaagacagacctttaatagttgctagtactgctaacaattaaaataaaacatttacttgagcttgaaaaaatatttcagggatggaacaggaatagtggggactagtattcgggtttttaaactgctggtggaagtgcagtattagaaggccttaaaaacttgaagaaaacaaagaccagtctaggataaagaagtatattctacttaatcttcatgtttgaagtaggaggcaggaaggattaatgggggttcaacttctacttcaaacagtttccctcccttttgctgggttgcaagggattgtaaacagcctcaatttctccctctttatacatcttcttccctctttcttctgtgttatgcattgatatttctttatgtttgtgtgtacacatatactagtatttctgtattgagtaaaataattcaaaacgagaatagttgcattaattttacgacagttaaaggaaccggctttattggttccattcttcatttttctgcattctagccttctcgctttggttttgaaatatagaagtactaggtagcctctgtatctagcttgattctttattcactgaaaacacagctagtgttttttcagtcctatatgagtgctccaagagttgttagaaataaacaaaagaatattcatagcctcctggaaatagctagtttttttttttttcatttatcctttttactttcttccttttggattctcctcttctttccactccatctcttaattggcttgcttcttggtagcctatatattctatacaatgacttactaaattactggagtaatatcgacatacttgcatacatcgtttctcttttttcctgtagggcacatgtctcaaacagaatataattatagctagatgctgagtgggaaacaagcagtccttatatattgaggacatgagtataagcctgagtaactattactactgatagaaaaaaaaaaaacgccaaatttaaaaaaccatcaccattcatcaatttttaaattgtatctcatgtttaaacatttatttgcttcaaatgaataattaaagtcagtcccatctccccctaaaccaaaattaagtagcattgaaattccttttcatagagagatatatacgacaagattgggtatttggaaagatacagacactgcttgcaactataaaaacaagatcaaaacatttggatgccctttctccacttcagtaggacagcaactacacaaggctattctctggagtaatgatcttgtctccttccaaaggtttttttatcctatattcaggaggtcatatgcagtcttcagctgcacagagctccactcctattaatttaaaatgggggctccagaggttcacattcagcaaaatctgccccttaagaggtaagctttaccaatctcccatttgaagaaaaaaagaagcgtttatctttggaaaaaataacctacttaaatagtctatcttccctaacaagaaataaagaaaaacttcagacataagttaataaaatatccttttgattaaacagagttcactttattttcatgttttggcaacactgttttagtggatttgcatgggggggctctggtattgttattttatcattatattatcattttgttaagctatctggcaaattgaaaaggttattcaccctatggctgtctttttttttttaatgttgagcattcattgaaaagaatgaaagaaatctggttgaatatgcaggtgcactaataaatgggtggtctttggattacagtatttatgtgtactgtggcaaagctgaacagaaacctaaatgttatacatacaaagtggtacaacaagaacatctgtgttggggggattgaactggcatggctaacacctccagtgccaggtgcaaaggaaatttcaatacagcttgagtaatcttgactgctagcatctgcctgcatcagattatctcctatgttcctagtccaccactatccattagagtatttatatgatacatctggtggtgcaatggccaagcaagaagcagcaatgcctccgttactgggggcaaatgcctgactctttaactcaatacaaaggcaaacaggaattcatttcaggcccacaggcagccagccaactcttcaagactaattagaagatagcactccagtgtgatggctgctttgtcctttcagtttagttacttacatatccatgtgcacaatctgcagacatttaacttttcattttaaaatcctatttctaaatatcatttccaggaaaataacagggttttaatatgttgccagaatcacaacagagctttaatgtgacttggctcaatccaaagtctcaacatgcacctgattttcagaatgaatcaatgtggtcgggtgagaatggtggagatcatcagtccattagtctccgcaacatcaaatctcacatgtccaacaacacaaagattatgtccctctcttcaagtcttcaaatctttctcacctcaagagatgactgtgtcacctaatgcagagaaaatcagtgggattgctttagcagtctgccatctaagaatctacataaaccagcacctacctttcctctctgcttcctgttaccatagatgtgtgacacctctgtctttgactttataaagcaaacccatctcttcctgctttatacacccacatttccctgatttttgcatgcactccccctctccactgtatccttgccatctgaatatattgatccacttgcaatcctcttcaaagaaaacctctgtagatgttatgttcccctacagctatcaccttccccagggtgaaggtgttctttcacaatcaaacatctttataggtttcttcactgtgttctcctactcacctctcaaactgttcaaatctggctcctttcctcaacatttcatgagactgtatcatataaattgtataggtcccatatcttcacgctgctaaaatcaaagggcttcatcatcctaatagctattcctgcagtatttgaaacgtgtgaccattacttcctcatgaagtctctttccttagcctctactatgtgatatttactctcatgttttgtgatatttactctcatgttttgtgattttactctcatgttttgtgatatttactctcgtgttttgtgattttactctcatgttttgtgatatttactctcatgttttgtgattttactctcgtgttttgtgatatttactctcatgttttgtgattttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgatatttactctcatgttttgtgatatttactctcatgttttgtgatatttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgattttactctcatgttttgtgattttactctcatgttttgtgattttactctcatgttttgtgattttactctcatgttttgtgattttactctcatgttttgtgatatttactctcatgttttgtgattttactctcgtgttttgtgatatttactctcatgttttgtgattttactctcgtgttttgtgatatttactctcatgttttgtgttcctctacatctctggacacttattcctagccttctttggcctccctttccaccatattcaacaattcaaggatggaattatgcagggatttgtcctgagtcatctcttcactatactttttccttagaaattctcattcaccaatacggcttcaattgccatcatcttgcagatgagctacacattttaatccccagcttagagtaaatcagtttcctaaacttcaagccctagcatcaaatcattcattcaacatctgaatctaatacttctgaatctaactcatcgttctctttgccaccaaaatacttttttttctaaagtacctagtccttccaaatttcaccaccatccatctaactgattaagctagataattcaccatttttgacatctctgtcttgttccttttccaaatcgatcaattagtaagtattgccaattaacttttaaaaacgtaaacattatacatgactatgtactttataaaaaatggcaataattgtcctttcatcatcactcctaatccttgggcatctttctttacacagaggtaatactaattatgaaatatattcattcaaatttttgtctattcttatactcatatatgtaccagttcaatttgaaatatatcagttttgtatatcaatttttataaaaaaatggtaacacattctaaaatttgatttattcagacaaaaacatgtcctggaaagctattttcgtatatatatcaatttgattcattttaattaatgcccaaaataccacagtatatatatccctctgttagagtttcttctatttaaagttgcgctttctcattttttctgttaacaatgctgcaatgaatatattcaagcatggctccttatatgaatgattctcaagatagagaaatagagattgaaaagatattgacatattacattcccaagtggtactgggagaaaattctccatggatttgtcacttttctgtatgtctgggaagcaaagcatcgtctgtcatttattccataatatcttttaaaaagatgtagagtgaacagccttggaaaacaacatgtctccctctggagcaaggggaaggtatgctaactcttcagtataatagcatttcccctaagcttggagttcttctcctatgatgcaaaccattgcagaagcaggtgttacctggcccccttagtgtcatcctgtgggaactgggacttcaggaactagtgcaaaaatgctgattattctggttgctgttattgctctgagtaataaactaaatttatctctggcccaggattctcatgccttccaccagctttcacagaactgtggtgacggtgatacagtttaccctctcatcatacaagtctgaacaatatcagcttcttcacattacagccaataagtgatagtaataaatgtttctttttttccaaataaaataaaagaaaaaaggtatcttatttcagtttgcatttccctagttattagtatagtgaggttttacatgttgcgttctctctctttccttcttcctctttttctctcttgccatttatctcttcccaagtactccttatactttcacttttgttcatctctgatgccaccatcctagttcaaagtagctgcaattatttcctaactggtctccccaagtctactcagcctccctcaaacacagatctgatcacatggcttccttccttaaaaacacttggtctttccaattgtctttaggataaaacttgaaacccttgacagggcctacatgctcgggataatcttgtctctagctctatttgttgacactcttgtcttcattttcaacttacatttagcttttaactttcttggatatggcacgctctttcttcttttggggatttcattcatttagaaaaaaaattccatgtgctatttcaaattaatgttttttaacaaagaaaaatttaatgtttaggaaataaggagaaaaaatctgctttggttgtaaactgcaatgaaaagaaaagaaaaagtttaggcagaaaatatatgtaaatattatatggtacttatttctggataaggggataaatgcattttcttattttagttattttaattttctctattctttctttctccaacaaacatattttgctctattaattagaaaaaataatcttaaaaaactgcttttttggcctctatcctgctctctcctattacataattacaacaaagcaagtaatgaagtttcaaaaggaaaagtttaggaagaaaatatataatttcacccacaaaatgtagcacaatttcaaaaataccaaatgaaaactaaatgcccaaacagcttctttgtcatcacctaagctaatttcaaatgaataagactaagggaatacagtactgaattgagaaggccaatgcctgcctcaccagttttagagtcagagtcacacagtactgtcctgacttccattcgctcctccctccttctcccactccattgcttctcctcccactcaacatttagtaagcactgtctatgtgcagtgaagtgaaagtccaagaagttcatgctgaaatagaggagctgatctgtaagtacctacactcatcctgatggcaaatgaacagacaaaagcatgaacgcaatgattatgaccggaggcagcagttgagtggtcttgagaaaagcatggactcttgcctggtggctgagagatgtagtgagatttctcatacagaataaacaggaagaatatggcaatctagggcaaatataaacaatcccataagaaaggaacctgtagtataggcatgcatgtgagtcaaggtgattaatgatgaacctgggagaaaattaaggttttcgagccacattagtctcaagggtaaaaaagaggcaatgtatttataaagtgccccacaaaatgcagggccccatagtaagcataaatattattcattcttcctctcccatctcttgcacgtacactccctttcaaatttcataaaagtctatgtcatgtagatgtattccaaataataataaagatggtaataatagtaaaaataaccactaatctataataagtacaattagcatacaaatgttttacacgttttatctcattcaatcttcaattactctcataaggtggctactggtattaccttcattttgccgatgaggaaaccgagacacagagttaagtaactggcctaattaaattaattcatggttgaggtaggatttgccatcagccattctgatttaggattggagctccaagataataacagtaactagaagtgtaattagtaaccagtgttatttctctgtgcaatgaaattatatgcaaatggaaaaagacaagatttgaaaggtatgcattttattcacaaaagtcaaacattaaaaaaatttatttatacaatgttaagcatgtttctctctgtatgtttgccactttgtatatatggcctggatattatttctttaagcagattaattttcagattcattcacaaacagttacaaacctcttactatataccaagttttatgttagaactttaaagagttgaaaacaagcagataacattcttgccttcctggagtttatggcctaatgagtataacaaatttaaaacaaaaatgaagatatacgattgtaaaatataacaaatgccattaaggaaataatatgaacacgttatgaaatagaacaagaagaagaaataatttaaattttttctactttaactttttaatctggacagaagtggagataaggaatgtggttagagaagaaataaaatgacactggtaaatatcagtaactattactcaactctcagccatgtctaagtttttttggactttcaaggtcacactagtgtactgttatatgtcatgagtaataaatttggtttaaatattattatgaacccaaattatagaataaaaaggtgactatgaaaatgcatatagcaggccgggcacagtggctcacgcctgtaatcccagcactttgggaggccgaggtgggtggatcacctgaggtcaggagttcgaaaccagcctggccaacatggtgaaaccccatctccaacaaaaatacaaaaattagccaggcatagtggtgggtgcctgtaatcccagctacccgggaggctgaagcaggagaatcacttgaacccgggaggtggaggttgcagtgaaccgagattgaaacattacactccaacctgggtgacagagcaagactccgtctcaaaaaaaaaaaaaaaaaaaaaaagaaccatatagcaagttccctcttttgtcaacgtgtatgtgtatgtgtgggtggggagggaggtgtgtgtgttcttaaaataacttaaaggtcttttaaaggacttacaccaatgtgttggtaatcactgtcttcagtagatagaattatgaatgattttttgtttctttccaacaatttattttctatacagtttatcagtttttatgtagtacactgaacaagaaaaatgtacaaatatatagttttaaaagtttttctgaacctctaagctaggatcttgtttcatctcacacactgaatgaaactttatgaattgagaaagccacttcattccctggccttcacatcaaatgacaagagaaagggccagacagtctagtctctaaggaactcctagagatccagagtgtatctaaagcagatgcctaagtattctaaagtcctatttatttattaaaattttaaagtgagaataattcagttttatctataagtaatattttttcagtaatactttttataattgtgaacaattgttcactactttcctctacctttatttgaatttaatgtttggatttttgtttgcttccttgggacgtgggtttttttcctagacttcaaatctctgaagccagtaccttattccagttgcaatctgtataatttcactttttccatttttagtaacattaaagaaaaaaatcatcacaaatcattcttggttgtttatctggacaagtgttctcaactattccaaagctctaagaccactgtaaacttttgaaatgagtaattataccaggtttatataaaagtcatatgctgaccagttacacgggaaattaaaaaaaaaactagaacgtacatgagaaggagaagaacaggcctcaaaacaagctaaaagtgagatgcaagtgaaaaaaaaaatcatacgtccacatatagacctgtatgaatattttccacatggagctcaaactatctagtcccttacgctttccctgtgaggtcaccatgggcttaatgaatgtaccggtgcttgatagaaagttaggctctcctcaagacaggtgactctccatctttctcactttttatcttttctttctttgtccattgaagtctagatggtgtccctctattgcgtctgaatccatggtcctgtccatacttttgtaataataaatacctttgtaaataaacccttctgaggacatcctaacttgtttgtttcctagtaggttcattactaatatgcaaatattagctttcatttggctttaaaataaaataagctttatttggaagggtagattcatatgaaaacaagacacatgtcccagatgaaacttcgtgttcataacacttaagccttcaaagtgttcagattatgtaaaatttgagagaaaagaataatcagtttcaatacgaggtattccagtattcatgtgttcaaaatagagaagaggaaaagaaatggagaaggaatttgaaatattttccaaacagatcatacacttgacctctagcttaacttagctatgatacttgaagtcatatttacaaggtcatagttttaaaaggagatacatcttgatcaagattactctatttgtctctacactgaaaccatcttgcaaaagcattcaatagttaaataaaaatatctttctaatgaaaaactagtgaaaaccacaatgatatttgcttaacctcataggtgaatttgttggtggtctaagatgtctgccaacaaaagctctttttgtgctttgaattgaccaaaggccaaatgctaatggaaatgaatacctgatctgctttgaaagtgaatcctgcctacaatgaataagagatggcttgaaggaagataaggggaagctgatcatacttttgtccatttatggactttctaaactaaaatattacattatatcctttgagaaagaagctgaaccaccattcccgggacagagtttttttttatagctttattgaaatgtaatccacatatcattcacccatttaaagtgtgaaattcagttttttttagtatattcaaagttatgtgcaaccatcatcacagtaaattttagaacattttcatcacttcaggaagaaaccctgtatcttttagatattgctgctgtattctccaatcccccacctctcaccctcagtccactattctcccagcaactaatgatctactttctgcctctgtagattttcctattctgaatatttcatacaaatggaatcatagaatatgtagtattttgtgatttccttctttcacttagcatgtttttaaggttactccatgttctagtttgcatcagtactcaattcatttttataagtgaataacatttatttgtatgaatataccatattttctttatccattcatcccctgattggcattttgattgttttgacctttggctattatgaataatgttgctttaaacattaatgtacaggctttctgtagacataagctttcagttttcatggactctgacctaagattggaattgctgagtcaatgttctaaatctatgtttagccatttgataaacttgaaagaatgttctctaaattggcagcactattttacaatgtgaccaacagggtataagggttatgatttctccacattcttggcaacacttagtgttatctgacatttttattctaatgggtgggcagtggtatttctttagggttttgatttgcattttcctaatgactaaggatgttgagcacctttgcatgtgctgattagtatctcttctatacgtatatataccatttctatgtgttctttggataaatgtctattaaggacatctgccatgctgtaattgggctatttattttttgttattgagttgtatcattacatattatagaaataagtctctatgagatatatgattccaattattttctctcacttgtgttgtcttttcactttcttgatagagtcctttgaaatgcaagttttaaattttgatgaagtccaatttacatattttttcttttgttgttcatgctgttggcatcatatatgagaatccattgctgaatcaagtttatgaagatttacccttgttttcgtctaaaagttttatagttttagatcttacacttacatccttgattattttttagttaatttttctatacagtcatgtgtcacttaatgagtggactactttctgagaaatgcatcattaggtgattttgtcattatgagaacattatagagtgcacttacacaaatatagatgatatagtctactacacgtctaggctaaatgggatagtctattgctccccggctacaaaactgtacagcatgtttactgtactgaatactgtagacaactaactgtaacacaattgtaggtatctctgtatgtaagcatgtcaaaacatagaagaggtacagtaaaattaagttattattatcttatgggaccaccattatatatgcagtccatcattgactaaagcattgttaatgtggggaacgactgtatagcacgaaataagagtccaactgcattctttgtatgtagatatccagttgtctcagcattttttgttgaagactattgtctccattaaatggtcttggcactcttatctaaaattagttgaccacagatacatgcatttatttatggactcccaattctatgctatatatatatatatgtctatccttatgttactaccacactgtcttgattactcatggtttgtactcctttttcgaaatcagaaaatgtggatactccaactttgttaatctttttgaaatattattttggcctgaatctcttgcaattccaaatgaattttagaatcaccttgttgatttctgtaaagaagccagctaggattctgatagtgattgcattgaatctgtagatcaagttggtgagcattgccatgttaacaatattaagtctcccaatccatgaacacaagatgtttatctgtttatttacatcttctttaatctcttttgacaatgttttgcaattttcaaatgttttctttcttttaattttttaaaatttttaaaaatttctttcaatgatgttttgcagttttgaatttcatttgctaaatttatttttagcattttattcttttctgaggctataataaaatttttttttaatttcattttttgttgtgttgcaagggtctagaaatacaattgattcctacctattgatcttgtgacttataagcatgccaaactcattgattagttctaatattattttggtgaattccttaagatctcctatatataagaacatgttatgtgcaaatagaaatagttttaattcttccttttcaatctgatgccttttatttatttttttgccttttatttatttttcttgcctaattgccctagctggaacttccagcacaatgttgaataaaagtgatgtaaatggatatccatgacttatttctgaataaagcatctagtatttcaccattaagtatgatattagttgtgggttttacatagaagccctttatcaggttgagtactctctatttctagtttgttgaatgttttttattataaaaattgttaagttttgttgagtactttatctgtgtgtactgagttgatcatgtgatttttggtttttattctattgctatagtgcattacattgattgatttccaggtgttaaaccaactctcattcctgggataaatatcatttgttcatgttgtataattcattttatatgttgtgaattcagtttgttagtattttgctaagaatttttgcatctatattcataaaaatattggtctgttatattcttttcttgttatatctttatgtgatttcagtgtcatgataatactggcctcatagaattagggagtatttctcctcattttttggaagggtttgtgaatagtggatattaattttttgtcttacacatttggtagaatttgccagtgaagccatctgggtctttgcttttctttgtgggtagattttgattactactctgaattctacacttatcaattcagattgagtccatttcttcttgagtcagtttcagtagtttgtgtctttctaagagtatgttcattttatgtaagttatctgatgtagtggcattaaattttttatagtattgttatagtcttttcttttttaaaggctgatagtaatactttctctttcatttctgattctactagtttgaatcttctctttttcttggtcaatctagctaaaggtttgttaatttcgttgatcttttaaaaaaacttgtttttggcttcactgactttttatatttttttcactttcctatttcactaatttctgccttaatctttgttttttccttccttctgcttgcttcaggcttagtgtgctcttctttttttgttttgcagtgtctgaagattgaagtataggctatttatttaagctgtttttttcttaatgcttacatttagtgcttcaaatttctctctaaacactgcatccccaaaatttggtatgttacgtcttcattcatcttaaggtgctttctaatttcctttttgatttcttcattgattcattggttattttagagtatgtttttgaattttcaatgttagtaaatttcccatatttcttttgttattgatttctaattttattccattgttgccaaacatgttttgtattatttttcatctttgagctttactttatgggctagcattcggtctatcctggagaatgtttgatgtacacttgaaaagaaaagcatagtctacagttgttggctggagttttatataaatgttatatagatatttattatattggtgtttgtacagatgctgatacacatacagtggttcacagagttccaatgttctatttccttgttatttctacctaattattctaccactttgaaagtgggatatagaagtctccagttattactgaattgtctatttctccttccacttctgtcattttttgctttattttgattttctgttgttagggtatatatgtttacaattcttatatcctactgaaggattgacgatcattattaaatgtccttctttatctctggtatcattctttgttttaaactctatcagtataaccactccaactttcttgtgattgctgtttgcatgatctgtctttcccagtcatttactttcaatctattttttatcttgtaatctaaagtgtgtcccctgaagagagcatataaatagatcttgtttttcctccccattctgacaatctctgcctttgattaggttatttaatccattcacacttactaccattgttgatatggctggattcatgtctgccatcttaatttttgttttctataagtctgatgtctttgttgtaaatctattgctttcttttgcatttagtattttcaaatgcagaatttatcttactttaatgatctttttactatctcttcttaagcaaccttagtggtggctctagggcttaccatctacatcttatcagaatcagcttcatatttatactaacataattccagtgagatatagaactgctactcctacataatgcaacttcctttctgaatttttatatttttatacctattacatctataaatgttacaaacacgttactttcctacattattacattatataattttgtatcttttactgaagctcaaagaataatatatataaaaaagggcaatgaatatgtatttatactatcttttataattcaataactatatcagtgccttttgtattataatgtggattcaagttattataatatctggggtcagttgctttcaacctgcacacttgcctttattactcaacgtgagtgagttagcaacaaattttctcagttttggtttatttgggattatgtttattttgctttcatttatgagagacttttgatcaatacagaattcatggttgatttttttttctttcagccctttaaatacagcatctcattgcatactgacctccattgttttaggtgggaagccatctgttagttttctttaaattcacttggaatttatggagtgggggttacttcttgctgtttctaaatttttttccaggtctttttccaggtccttttttccaggacatttttttccaatgtctccaacatttttactatgtgtgtatgtgtggatttcttcacgtttatcctatttggagtttgttagccttactagatatgtatattaatatttttcaataaagctgggtagtttttagcctttttaaaaaatatttctcctgcttcctcctatctttatttcccttctagtactccatcttgcaatatgttaatatttctctgagtagcatttttcttcattgttaaaaattgtttggattatataatctttactgatcaattttcaagtcattaattatttctttgccacttcaatccagggaaattttcacttcagttatttttcaacccttgaatttaaatgtttcctttgaaatagtttctatttttatgtataatgtattgatagcatttatttgctgtgttattgttatcattctcttctttactttaatcatgatttcttacttctgtgtacttataatggctaatttgaaggctttgtctgtttaactcaatatctgcttgcaatcacaggtagtttctgttgcctgttttttctcccttgtgtatgggtcagattttcctttctcttcaggtaccatacttttgtattagaaacttgacactttaggtaaagcattttagctattctgggtactcacattgggacttgtttgcttgtttgttttgtgactgtctggcttatctttgtgaattctagtccaccaccaccaccaaatgccccatttttccctcttgtggtgtgaagtttctaataatgctcctaagggaatacaaccttggctatatgccctgcaatgatagtgactttttcaggacactctttgactatctctttctttgaccatattcaatttcactaattaccagcctcttatgctcttgtttttaacaatgccctggtgcatagattgcttgaccaacagatccaatcaaattcaggattatttgaagagatagttcctgaggtcggtgtttgagatatgttttgaagttaggaggacacttcctagttgcctctattcgtggttcactccagcaaagtagccagcctacagtgcagcctgcatttccaaagaatccaccaatctccccccaattgcctttcatcattaccttcactgtttttgaaagcacccttaggtttgaacttattcacactctatgacaaattaagtcagttcctgtgggaagagatatggagctttctgttttgcagtctgtttcttcccttcgcaaaacctctgacagccttcaaactggcatggggacaatagtacagtctttctgcctgacactctaactttagttgctgagtatgggagactcaagagttttaatagattttcttgactacatatttatttatttattcattacatgatccatgtgtgcctttttaaggaacatttccagagatttgttgcccctaagaccataagaccatgtagagagacttaaacactttcttaaagcggtttttatcagtttcaccaaggagtgggtccacagagctccttatgttgaaagagaaacttttactttttaaaaaatctagctacttgtattaatgaaatgtttgtcctttttttatagcttgaatgtggctaaggccacataagcaaataattcttatatatagatattaacaagagtgatcggaatattgtgatgggttattttgatcaggttaatgatatagacaatcacaggatatatttttaaaaagtgatagagatttaaaaaaaataacaattagtggattaattaagagtatcattttctactttgtctaccacacaaaggcctaaatttagtctttaaatatagtcagtcaaatttatgataataaaatgtgctattattatataaagggaattatttatttactacttaaaaatttagaccatttaattttataattaatttctctaaaatgaatttaaaaatattactgtcctctatgcttggtagaatttctatttatttttgcctccccataagtcaccaatctcctagtttccaaactagttagtaagtttccatttgaaatatctgaaggtcaaattattatttagctatagatatccaaggattgagaaaatgtccaatcacataataaataacctgtcagaatcccaagaaggtataatagaaatgaaataagtaaaaataaatccacacacagagacagaagcctatcagaaattattataaatggttgaatttcagggaaaaatgctattacaaacatataatccctagttactcattttttttcttgattcttagatttaaagccagattccttcattatttctgacctgatatgaaacaccatctggcatgtgcgtgctaagaggattatatgtaagcaaaatagatatgttttttctccttctgactctaagactttttaaaggcgtgtagattatttaggtttgaaatgtgaaaattaaactggtaaagagaaaagacagtttctagtaatatattctttaaaattaaagcaattatacattgctttaacaatgaagtattttaattggcattctgcaatatctcttttaaattttaacatcatgactattttccttgaggattataaattaagattccctagaggaaatgataaagattttcataattatcttatgattcatacacatatcaaactgtatctcatagctcactaaatctatgttggccaaatttttcagataattatcaaatatttatcaatatccagtttcatttaacttataatacatgaaatgaatcaattatataacacatataagattgcaattcatgtttgtggttacttttcaaaatgaagaatttctgctgtttttaacatttactttaaattacataattttaaagctagtagtttacaagtcatgtggttaaaaaagaatctcatttatctatttaatgggggtctcactgtgttgcccaggctgcactcaaacttctgggctcaagcgatcttctcacctccaccttctaagtaactgggactacaggtgcccgcaccgcaccaggcaagaatctcatttttttgtctgtttgttttaagagaaagctgccatccagaaaggatatgtgacttatctcaaggcccacagctatttgatgagaagtccagggttagaatacaggtggtccaagccttggttcattctaccttggacactactgtgtttccttcacaatcctgatgaacttttgttcaaaaaatttcactttggagggtctgagaatatatatagttgcccaaacttcatgcacaccacactgtaaattgaactagattcacactttggaaagtaatcttttcctacattcttactcaaatgactatagtggctaatgtttgaattgcaaaacatttcctaaatatgcaaactaccagataaatctatgagaaacagccaaacaaactagccaatgcaaatgaaaagaatagatcataatgaaagtatccaaaaaggatctgctaaagtcaatctaccaggcatacaagtgatctaaatttctattttatatatggtataactaaaacttatatggctttatcttgacaaaattacacagaaaatagaagaaggaaggagggaggcagaaaggagaaggaggcagcaatcttgtttattggcctagtcctttgtgctggagtatattaaaaatgcaaatactaaaagcatggaacaagggcacataatggcatatatatttcacacatacctatgtgataacatttacccataatttcattaaaacaaaaagcagcaggcaaaatgagagggcacttaagatgtggaattttattaaaattttatctattctcttttatctcttgcatataagatcatatctatgttcagaattctgaatgactatgtatgccacaagaaaatataaaataaaatagtttagcaagatttttgttattgttgtcagctgtgtctgacaagaatatcaattaagatggcatttgttaagcccttgtctatgctgaactagctacagtatagagtagtttaacccatcttatcctataggctcagagaactcaattccagaatcatggagaatttctggctttgacgatgagggttattatatcatcagcttctgtgtctcactaattccagtgatgacaagatttttcatcatttatttttattttatttttacaactggtgcgtgttaggtttgtagaacacagggtagaaacagctggagttagtgttattatttttcactttgaaggaaataagaggctgacaacagtgaaggacaaagacaaagttgttgctggacatgctctggcacataggccacctcccactgcaaccagttctaaattaattatttattgttattttagttgctgtaactttctgaagtgtcctatctattgtgaatgggagtttcaactcattattgttttgtaaaacctaagactctaacttgaagagacactaaatttaatatgagtaatctgaaaacaattttagagctgtttatagtacacacacactcgcacccgcacacacactcacacacacagtacagcgctacactggctgcttcataatgccactcagacaggactacccacaaagcacactggctttgcccaaaactaatggatgtgagcaaaagtgaagctggtagatgattttgaattttgtagcgatcagtaaaatcaatcatgagagaaattaacactaagattttcagggccaaataaatactcaacctctaccattgctctggacatattaaaacactttcaaaaaatgtattcttttctgtctcaaaactcattagttctgtcatcaccaaagaagagtaaagcttcaactacctagcatcagttttttttctgtgtgtgtgtgtgtgtgtgtgttcaaaaataatttgctgtgaatggtgataatgaattaagaatagcatttagaagtactcacagtaaatttgaacatataaatttcattaagaaaatgagcaggctgtgctgaaattatacacaaaaccaatgtatatgtatgagaaaatctattctacaaaagaagggcagaacaaattttgcattagcccaaattaatttacttatatataaaatccagcagatctgattatttctttgttagagaagttttccaattttaaacattctatattgtgtttataatatgtggtcagtattactcatacatacatacactcatatacagtaatgcattgctcaacaacagggatacattctgataagtgtgttgtgagatgattttgtcattgtgagagcatcaaagagtgtacttacacaaatatagatggtatagtttactacaaacctgtatagcatgttactttactgaatactgtaggcaatggtaacttaatggtaattatttgtgtatctaaacataactaaacatagaaaaagtacagtaagaatacggtattataatcatatgggtctagagttgtatatgcagttgtcattgactgaaatgtcattatgcactgcatacgtgaatagatatggatatatatgaacacgtgtatctatatttatgtctgtagcattatttatttgtttctatgaaatttataccactatagaaatgccagaaaattaagctatctggggagaaaattactggggttaatctttagggatattgttttttcaacaattacaaaatacacttatgatcaatgaccatccttcattcccaagaaatctgtctctaagcataaagttgttaaataaaatattttgttaagtgtaacaggataaattatgatatattccgtccatgccaagataaccaaatagttttaactgatagaaaaacatgtaaaaataaatattagacaaattttatatgtattaataacaataatgcaaaagtcaatgtagtttgtacataaatgcaatgtaatgaaattttcctatctttgccaaaaggtaaaactgctttatagtgaaagatttgtggtggaggaggtgcgaaaaagagttggtctttggaaaagtcttgttgcatcctttttttctactgttgttacttcctatgggctcatacttaccttgtactaaacctgaacttaacatttttagggcaaaacaaatatttaacaaaagagtgcctcaaaacaacaaaagtagagttcatgtgcaataaactgaagtactttgtcttcattcttttacttggcaaatacacacaattcaaatttattccatatgatttctctttctagaaaatgtgacttcacataaattgatgaatgctttttttgcctgaaaccatgatgtcaaaataatacttagcatggcctagtcacttagtgtatttttggggtaaatgccattatactgaaggaaaaatttctcttacctgaaaaatggtgtatgttttcaaaagctgttatggtaaaatttcattaattaaagagttattatgtgaggtaaactgtaaagtcaaaaatactccacaaattaaaaaacaggagtagaaatcaatgccatcaaataagatagagcaataactaaactctttcaagtgaaaaacgcatataataagagaattattgtaacattgccacattttattatgactctatagattcaaacatactttaaaaccttagtttaaactttagaataagcttctgagatcaaccgatctttcttactagtcttatctcttttcattctccttgtttactttgctcatttcactttctataaagaaccattctctattcagagtaatctttatacacattactacctctgtctggaaagctaccctctccatatttactactaagtcaaagtacctcagggaagtctttcttcctctcctaccggatgagatgtgttcttaacatgtaagactattataaatattttcacaacaattaaataattactatgttataatttgtgtcttgactactattatgctgtgatcttccaggaggacaagggctaagtccctaagtctctgttgttcattgttggctgacgaattgtattaagcaaggttaaaaattctttcttctttccctttctttctttctttctttctttctttctttctttctttctttctttctttctttctttctttttctttctttctcttggtaaggtctcactgtgttgctcagactggagtaaaatcatagctcactacagccttgaacttctgggcttaagcaatcttctcacctgtgcccctagagtagctgggactataggcctgcatcaccaccatgctcagccaatttttaaaatcttttgtagagacaaggtcttactatgttgcccaggctggtctggaacttgtggcctcaagccatccacctgccttggcctcccccaaaatatgctttttaatgactgtccagttcacgttatattttctgataacattctacaaaaaactatttaataaaaataatttattagcatttgaaagagatatatcagaaaatcatgaaaagatttctgcaggaaaataatttccatattataaaattatgcatattttatgtgtgtatatgtttattattatgcatatgtatgagtgtaattgcacatatgtgtgtgtgaatgtgtgtgtgtacatatatttatatatagtcttttggtatgaaatggatggtaattttctgctatacagaaaaaaaaataaaactcatactgtgttctattccctaatagtgtctgaaggttcactttaatgtgattctgattaaagatggtcatctttattgattttcgaggaaaagtaagttgaattgatgtgaagttttgacatttctaaggaaaaaataccttgtgattgaagtatgtcagtaacagtattcaaatatcccaaagtaatcaagtcttctatgtaatgtttaacttagctaaagcctcattcggtgggtttgagagaagttgatgtgtttattggattttcctcttagtctttctgagaattcttaggaatgctttcaagacccaaagatggttggcccatcccggtttgctaaggaccacttccggttgcttttatcctctcatatccttttgcctccctcttttcctctcctatatgggataaaatgaagtgaagatctaagagtaatataagaggattaaatgaagaattgtaaaaggctaaaggagattagacattcacgctccctagaatccatctgtcttatcttctcagagacccctacatactggcccattttgtactcaatccttcaatattttggtgttttagaatccatatgtctttttaggcaaaaggctgccctgctcgaaattccttgcccacaaaatctagagtaagttagtgaaaaaaaaaaaaaagaatttaatctcttcaggggttaaaggttggcttattattattattattactattattattattatttgttttgaacttaggatgattggccatatgaccatgcatttgctttagggaagaatctcatggcactatatccagaccctggagacaaaagcaagagaatcataagagtgaaccaaatgcatctcaaaatttgtgtgattccatcttaaactacctagcgtatagcatgcactcaggactaactcaaatccctaattcagaaagcaaaaaaactaactttttaaagggcacagtctgattagaaacaccccaaatgtgttactaattagaaaacaatatttagtgtaaagtgttttatcattttactagcttagggtttcattgctctcaaaataatgaagaggtacttgtaagacaaaaaagtgctcactaaagtagcaactcccagaatgatgaatctgtctgttttagtgacaaattctaggctctattctacaagcaaaacttctttacaagctctaatgtgtcaatttccaatctccaacaattttaagttcttgactacatccagagcatcaggaagaatctgctggtcactctgaaatagcattttgtttttgctacacaaagactattcaagcttattattcatgcttgttattttgcctgaatggttgcaaaaagagagtaatttcttgaggtgtcttggcttgagttggaagacagaggggaacacactgaagatccctcaagacaatgcaagcctatgtataagaagggacttgccttaagctatgcacaggcaaagaaagaaaaaagggacatagaaaggaagtggtggggaaacaattttcagacaattccccaccctagtctggtgatccaatgacaaatgggactgtctgaagcaactctgactgaagagcaatgtcaaagtctctctgtctctctttttctttgccaggggaggatgttcgtatttgctactttgtaaagcaatatttcatgccagtgtcctttgttcttgcctataaattgagtcccagaatttcctttttgctatcttgcaagcgtaaagtgggtgtgattggggataatgtcccccactggcagtccacgctccacactaatgactcttcccttagtcagacgtgctgtgaagtgaatcattgaaggaaggttgataaagcaggaatgttttcaaatgatttttctacacacttctataaattgcctaaagatgatcattatcatctgagaatatgaagtatagctgcgtggaggaggggagaaagggcggacaggtagtccaagagggaaattatctgcatcattgagaaccaactgtcaaagcagagaaaccagagtccagggagtgtgtggggggtgcaaccacaggtcgaagaagagaagagccacacacttctcaacccccctcccactccacacctactccccagagagtgagagaaagccggaaataaagcttctgtttgtcactcctcacatcacaattccacttaactaaacaaaggcctggcaaaggcagttttaaccctaaagctcagagtgagaagtgcacctgttttagattcaacaaaatagtcccaaatgcctggaaggcatggtatctttgtggtcccccttgcctggcaagtacaggcccttctgagctacaaacctctggctatgagttctttcttctttgcctccttgggatgaaactgtcagctatggagaaaaagtaaggaaccttgtgatggactttgaaattcaacataatacctaagtagtaaagataaaagaatcctctcctccgtctcacaaacacagttgcatgaacccttgtccgtgctaattgaccaaggaatgaagtataagatagtaactacagatttaaaagaaaaaaaaattcatacactcttctccaaaagtaagtgtaagatttctgaaaattacaaacacatatactacgtgtatatttatggttcttaaactacttgaatgtatcttagcagtaaaatatcccccaataaaatattcctctccttcttgaaaacatgaaccacgcaatgctaagtgaaatatttgttacaaatatttttccagtggtttaaacactccaaatgccaaataaattgcaaggaatgaataatatttttgaaaatagttttatgtgaatgaattgtttatgcaaacatagatttaataatctgaatccaaataacaaaaaatcattccaaaatattttatcaccctatccagtttttactaacctttatgccctcagaaagttactttatttcgatgcttttctattggcagcagtaaaatctcatggaacttagaaaaggtgatgtagggggagtattctccatcttatatcattgcagtattcactttaaagcaatgtagtccttttctgtttctaccccaacatttcataattatatcattttacaagaattgtgtaatttacataaccacctaaattgtcataattgctagaaagtgctgaaaaagcatacggtaggcatttcagattcatttctgctctctgtttgaaactcattttaaatgccttttgcataaaaattcttttggtcaacaaaaaagtaacttggatttaattttgcaggaaccttctcttcttctccctctcagactgacttctcttctttcaggaagcctttctcaggtattagacctgagtactaacagggtcacctggtaaacaaacccctcctcttgatcttacagaagaagctgagaccacagaggttagctgacttgatctgagtaccacaggtcacatctgcggagccaagactagaaatcacttttatttaacttgcatgttttgttcattgtcccgcactgttctacactgcatttagaaagaggaaaaggaaaaatacaagaatggaatggtctctctacagttttctcagcatgccatttctattataattatcttaaccatctgttttgcttggaacaggcaaaagaatttgatattaagaaacaaaattcattctgtacaacagagaagggcttcagaaatgagactttatttcagaatacaagagtggatatcaattttatcagaggtttcatctgtgaagtagaatgccagtatttgaccattactgttttgaaaatcagtggctcatgtagttttgtaaataaaaatgtgcaactcaaagttattgcagcatattgtttataatatttgcttagagtgtaatgtggaaacctgaagtaaagcaccactaaacagttaagggcattggaaaatggcaacttttcccaatacccttaattgtttttctttcttgaattctgcttcaacttctctcctaaaaagctaatctatccttgcatacttaaaagacaatgtattgatgtttagctccttgaaactaatttagctgttatgtgaagctataaaacttagtggcaacatatgtgataggcataaataatggaccacctttctggtatgcttacctagtgcacgtgtgcacatatatggacgcacacactgcaaaaaacacacacatggatgcacaagacatacacgcagatacacaaaaacaatttatgctactaataattcagagttttgaaataaataagaaataagctggttcacttattttcctttctgtcaaaaattactgtaaaatatgtattttattgcaaattaagaaaaaaattgagagtgatgtacctgtcttgcagttacaggcttttcaaattacagatagtatttgaaagaaccaataatacctcaaaatcattattttaaaaaattataattattacaaattaaccaagcttcagaagaggtaaactcccaacatgaaagacagcttatcacttttgaaataagcatggaaggcagaacaattttcatagaaaaatggagagtattcattccaattaataaaaaaaaagctattatttctgccaaaaaaaaggaaaattaatagcaaaggtaggatgaaccagagaccctttcaatattgtcttctagaacataaagttattataataacactaaagaagaaaaaaaacttgaaacaacatatacattgagaaaagaacaatttttctgttcaacgagaatcaaattttttacagctgatcgatgtaatatagttctgtaattttcgtgaaataattttagaactgctgggaaatctcagctgaaggaaacaaagaaaagttcataaaattttctaaaaatcaaagtcgtgaaattttttccccctatgaattatatattagaaacaagtaattcaattccaactttctctttcctgtgatagtgaaaaagcttataaaccaacaacttaacacatgaaagccattttaattctcacaccagcacacatctcacaagaattgaaaataaatagaaaaatatgtggtgaaaacagtcgtgtagacccctaaacattttcagaatttaacattaagcacttttttttttctcgtggtgacttttctttttccctttcctaagttgtaatgtgatgtttatcctccacttaatttcttggcaatgtggtagtggatcaataaatcaatctggcatattaaccctagcaatcattttggaatgtggataaacttctttctgttattgcttaaatttgtgctcttcctgtaaatgaggttcattttataaaccacaggtaaagttccatagtccagcgttacacttgcctagcacatttctacatgaatcatttgtgatatgctactactttgtttaaaatatatacacccacaaatgtaagtatttatatgcatatatattatttatgtataaatgtgaaggtgaaattgactccactgaaacaagcaacatgggctataaatggtatgctcaatgtattcatgtttcattcttcccttcctccattcctccctttctccctctttccttccttctattacttttgacttccttctggtttgtgtattgtcctttattccttcaagagacaggctgtgaaagcgctaatatatgaggaatttattctttaatgtagtgtgttcaatccactaacgtccttgcctaggccaccaaataggcattaatgtgagagcacagtcttgagtaagtatagataatatatattttattataatattttacagttactcaaggtaattttaaaaatgccatttgaattttcattcatatataattcatgcttttattttgaatatgaatcagaaacaggcctgagagcaacaaaatagtttatgtagtagaatcaataatatgattacctaagatatgcaacaagatgctaaaatgcattgttatcttggcaccgaaaaatagatcatcttttttaatttgcctgtttaagataacataaaaaacaagacgtttgttttttatttttcttgataatctttgcagtgtttaaggaatgttaatcattcattcattcaatattaatgtaaacacaaaaagtaatcaataatcttgtccctagtagaggtgataattattaaaggccatttatattactacatatgtcactaaaacttcacaatattatttttgtattaacacattttgaatatgtctattagattggtgtttcctatatatacacccatatgacaaatatctctcgggttggtgaaaggaaaatttctctgaaactcataacccttttatcagaaataagaattaatgaaaactgtttgatatggtttggctctgtgtccccacccaaatttcatgttgaattgtaattcccatgtattgagggagggacctggtggaaggtgattggatcacggggaggatttcccccatgctttctcatgatagtgagttttcataagatctgacggtttaatagtgcttggcagtttcccccttcattctctctctttcttgctctgacatgtgaagactgtgccttgcttcttcttctgccctaactataagtttcctgaggcctccccagccatgtggaatggtgagttaattaactttcttttctttataaattatccagtctcgggtagttctttatagccgtgcaaaaacagactaatacttttgatttttttacttagtttccaggaatttccaggctacattttgggcttaacaagaataacttttcttagagtacattttctgatttaataaaaataaaacagcaatgatcgtagcaaatcattctgaaaatggtacaggacagagggttaaagttgttgtcttctgtagagagaagagaggtggacgtgaagttgaatctaggcagggtagttacaggcaatcctctctatgtgggatgtctgggtggttgaattgctgaatggttacaaatggtggaatttcatattatatctatgagtacctagtaattaatttttagatgcttattgaaatatcatgaatacaaactaaggatgttagcatgctttatatggggtcttacatttttaaaaaataatttttttatttgttgtttttactaggtcaaaaaaggatagaaacatctaaaacaatgattatgttacagtgaagaaggactttgttttgtcagcaatggagcattttccaagggagatagatgaatgcccactcccactgcctaactttgtaactgcttttgctgtttgtttcctctcattcattttgcattcgtgttaggcttgcatctgtttatgttacttgtctattattcatctacaggataactgctcagcagtcgttacttcctttcatatcttttctgcatcttttgtttccatgggttgttttggcaataaaaccaagaaaagggtacaaagcttataaaaaagtgcagttggaacatcatgtttttacagctctaagaacattattgctgatttcaaaaagtttttttaaatgttaaaatgtattcagcaaagtttaaagctcataggtatgataaatttgaaaatttgagaaaatgaaatttaaaaagtgtttccaaaacagctcgctactgtttgatcttcacatggcagtctgccttgtgcaattctctgtttactgtacattttaatacctaagtttcaagcaatgaagtcatagtaattccttacatttgtatagcacttcataattttattgtgtgattactcattcattatgtcctctaatctttctaggtagataattagcatcttcattttaggataggaaaaaagagagtaataactttgttaaatgacatgctaagatcaaaagatcaatggatctctgagcctggaatctacactaacttgatacctggtgtgggtcaggagaatcctcacaatataaagttgctccagacttcctgcaagcctaagtggtaaaataaggtttggggattttagattatgttagcatagttttatgtgtgattttaaatcattattgtgtctccaaacttattaagactctatctatctattatcaagggattgaagtttagctgggaaaggggactaatacgtatctattttaccatattacctttataaatccttaaaggaatatactttaggtcttatttttgacatgaagaaaaaattaaaaataatttgatcctgctaccttaccagccactgcgtatacgttttgtttagaaaataatggaaagaaacatgtgacaaagtggagaagataacaccatagaggcacatatatgttctgtatcttcccttatcaattacatattaccaatatatatatgcccaataagcagaaaacttttctgccaaagagatttcacttttatgtctctgttaaataatttctacattctacgtcccactgttgtaaaagaacaacccagtaatccctcaaagcctaggttccatgtaaaataaattttgtacgatcattatgtagtacttgtgaaaagtcatagaattttaaaaagcatttgatttgcacccaaaacaaccaagaagtgtcaatgtttcaataattgcataattatttttaaagttatcatctttggagtgctaaagctatcattaagtgataaataacaacataattttattttggcctgtgccatcctggactcacctaagaaaccttagttcatacttccagatcattatcagagctgtccctgtgaccatggtgtaagatgactcctaaggaaaaatgaactatgtctctctatctcctcaaccaaaaacatcagaaagtgctcccttaccttttcttccctccccaagagaaagatctttggtgaaaaaacttagtttctgccatgtgggtctccttatttacttatagtggtgagaagctacctttctactctgacatcttgctctctgttgctgtctttcagttgttgagtaatcaactcttaataagctgagtgacagtaaatggttacagtttaggaggattaataaaagttgctattaaaatatatatatttaataagcacagaggtatctgaaaatgtttatatattctccttattgaatttgtagaatctgtttaggtaatcactaagcctttagacagaatctctccaggtttccttcaatagatatgactttaatatcaagtcagctctgtccttttgttgactctcagtcataaatgccagctagaggttggaaactcaagcatcattaagaaatggtctgaaagtgacttaaattgtgttctggcctagattaagcctttcagagcaactataaatgtacggcgctttcatctaacctagccccatgggcatttaatgaaagtaagtgctcattattgttattgttatgaattataatatatactgtatataagacaaaatcacaatagaaaaaacaaccagcagcctaatttacattgagtagtccaaacatacaatttctcccacctaaaatttttaccttggaattttctttcatggctatctgtaattctataaaggtcagcaaaatactgagctgttttgaccaggcaaagaagggttaaacataaatcctaatatactataattaaatatataaatgttatgttcctaaacccaagttatacagcttaatataaaaaacgacatataagtaataacctatagcatacatacgtcaggaaattgtccttaagaaatcagctgactttaagtagcttataaatactaaataaaaatatattgcaaatgaaaagcttttttaagttgaattggaaattttttttgtaactggtttgattttacctgaaagtaggaaagcaaagtaaaatgaacaagtaaaatttatttccctaaaccccagggagtttataaatacatcatgagaacatttatgtagacacaataacagaaaaggagaacattagagatacaatatgcaaattatgggagaaaatattaagaaaaacagttttactaacattataacatgactgaaaattaatgattaaataagaaaatatctcacaataaattatttttagaagcagagacaattaattgggataacaagacaaattgcatcaagatatatacacacacacacatatagatatatacacacacacatatacacacacacacacacacacacacacacacatatatatatacacaaaagtgacctaatttatacatttcaacacatttatattgaaaggtcaatatggagcaaatcaactttatttaatttatatttattaggcagatgatgcctgaagaatgcagaaaccttagccattttgatttgattctttcagtccctgacctgcctacaggctgacataattttccttcacagagaccagtctccagtggttaccaatcttgatcttccagtgtagactgagttctctttgaattactggagcagggtgtatgcgaggttggataaatcagccaaaccgaaaggccctgcagggcaaagaagcagtagggcacctgtccttacattgtcctgaaagtgacctcctgtgtgactttctgtgaggtaagaggtcattctgcctctactttggcttagcttatgtcactcacagtaaaggtcacaaatcctgacagctttcggtgcttgagactcagattactgcgtgtctgagaaggagcggagagctgtgagacctgcttctcttaggaatctaggtcagaattcattcagtaatgccacccaggcccttcaaagcaatatcttacattgtagaaatgctttgagcaaatcctgacggttgttcataaattatattacaacctgaagggagaaaaagttattctgtcccttttttgactccagcttcttataagataagtcataaaatttaattggtgtcctcagagcaaggtcatagttcttaaattcacctatacccttcataacctccaagtcaataataataactgaagataatgttagtgccactaaatttgatgaaagtgtcggcagcagttaatgtacaagaaacccatccaaatatatgaaggctgttttttttttttttaaagtatgtgacgctttctgagtgtctctgaaatactgtaaatgtttggaatttggactttatataaataggaagcatatgcacatttgttaacagaggtgacagtatgaagattggagattggaaaagggtaagatagagggagagaataatcttttaagaaagcaagttcagacattaaatgtaaataaatggaaaagtctatgaggaaatgctgtaagcctatttttaggtaatttacctttcctatacaaaaagagaggtaggaaaagaaaaaaaaatagaaaaggggagactgaagtgaacacttgcttattgctttgaggttgtataaatgttgccaaaactatgcccaatgcctacttaagtgtgggaaacagagttgacacttaaagaattgtgcagtggtgactctggagtctagaagcctgttgctagtgtgaatggaactgaactcatttcctttaagggaaaggccaaagacagtgagtaagtgataaaaacttgtggtgagaatcaagcaatgcggagacattaaaaaattcctagaaccatatagatgctaacatattagattttgataatgaataactaattcaaatatcctgattctttttaaaaatcaaagtaatgtgttgcatccacctaagacactattagaaatataggagctatacttttataccttggcatggcatttcactttccaaagcaaatatgtgagactgtctctttttaaatgtttcattcagggataaaatatgatgtttggattatctccttaacccactgcatccaataaataaaaatctctcctcttaatattacctctattctctcagtaagactgatgataattcaatcttctttgactgtaatctctctttccaattcatctacaatattgtcagatcttgcttcaaaatgaccccagctttgttttttctatttctacagccattgtcgtaacttgaaactaaattgggatccatgataactgatttattgtaccatctttgctatttgatgttggtcaaatcacctaacttgagtaaaatgaaggagtggaagacctctaaatctaaatctaaatttctcttattgatattttccttctatgaaatacagtgttatgagagattctgagagagagagacagagagagagagagagggagagagagagagatcaatttaccttccaggtgcttattatcacataaggggaataaggcggcttctgacagagtgattagggaagacataaaaaggagatcgaaagtggactaggccttgaataaagtgcagaatattaacaagtcagaggaaagggcagtaagattaaaccaccgttgctcttgtcaaatgttttctcaaaatttattctttcataagagcctttagctcaatgacactgttatagactgaatgcttgcgttcttcccaaattcatctgttaaacctgatcctcaacgtgatattagaagagggtgctggccgggcgcggtggctcacgcctgtaatcccagcactttgggaggctgaggtgggcggatcacaaggtcaggagatcaagatcatcctggctaacacggtgaaaccccgtctctactaaaagtacaaaaagaaaaaaaaagaaaaacagcagggcgtggtggcatgtgcctgtaatctcagctactggggaggctgaggcaggggaatcgcttgaatctgggaggcgcgggttgcagtgagctgagatcacgccactgcaatccagcctgggtgacagagtgagactctgtctcaaaaaaaaaaaaaaaaaaaaaaaaggggtgcctttgggagttgattaggtcatgagggtagagccctcatgagggtgactggtccctttccagagagtttccttggccctctcacatgtgagggcacagagaaaagacagctctcttctctatgaaaagtggtccctcactagacaccaaatatattggactttctagcctccagaactgtgagaagtaaatttctgttatctgtaagccacccagtctatactatttttgttataacagcccaaatagactaagacagtaatgaagttcaggcaactcttcttaccccatggctctcattacttctgttcttcatatcacatatgcgggagagtcatgtatgcagtactttttgaatggaaggaaaattgagattcatgaagatgtcatgagtaaatctccccaaatctgaaactaatttagcctccagatttactgtatattagggaaatgtgcatatgtacacatacacacacacacacacacgcacaaaacacacactgtgctaaactttaagaataataagagaaaagactactggctaaaaataaatgtcctactgaaaagtgtactaaaatcccatatttaattatgattatttaacagtgatatcaggtaaggatgatgtacatttgaatgtaattgattaaacaaaaatacagaaagcatttttaattaaatataccctattgggaaaagtactcaaaaactaaaagaatggagctgaataagccaggtaagcatcggaaaagggatatcacagaggtagattctagccaagaggtatggagcctgtctccaagcagcctccaacattcaaatattgtgggttccttggcaagactaatggtataatgggtaagagtgcttcaggctattttaattaaaggacaagtttaccaagaaaaattataataattttttttcctccatttaacatgatttctgccaggcgagacggctgacgcctgtaatcctagcactttgggaggccgaggtgagtggatcacctgaggtgaggagtgcgagatcagcctggccaacatggtgaaaccccgtctctactaaaaatacaaaaattagctgggcatggtggtgtgcgcctgtagtcccagctactcgagaggttgaggcaggagaattgcttgaacccatgaggtggaggttgcagtgagccaagatcatgccactacacgccagcctgggcaaaaagtgagatcctgtctcaaaaaacaaaaacaaaaacaaaagaacagaaaacatgctttcatgacgagaatgtgctggctagattggactgaaaatagaattatttgacagttatttcaagttgcacataggaattggcattctggttacaaattagctttctatatggaaaggagccttaataggggacatttctgtactggtttgtctgcaatgttcatgaaagcttcatttagcctaggtttctctatatattactgcttgaatgggttttctttatcagtatattatataaaataaaatctacatatattggctaataacttttgagtggtgattgtttgacagatgttgcttgacatgcttcacatctaatctgtaacaggactttatgttatctgttttaaaatgaatgtaattttatagccaaagggactgaggaatagaaatgttaagtactttgcctaatatcacacagctggtaagtgaaggagcccaaattcaaaagaagataatctagcttctgaacccacattcttaacccctgtggcaaacggcttgtcagattgggctgacaatacttaaatccatcttccgtgctgagaataccatatatgatttgctataaactaagtaacaaattataaagaatatactctgtaagtttggaaatcatactcaattttgttgttgttgttggctaagaaactttgggtaactttagcaaatgtggctcagagattagtcccctgatttatttatcacccctccagctttattgaggtataaatattgtatatattggaggtgtacaacatgatgttttgatgtacatgcaaattgtgaaatgattaccacaatctaattaacatatcatctcacattgttaccttttgtgtgtgtgtgtgttgcaagatctattctcagcaaatttgaagtttacaaaacactattattaactatactgctgtatattattaatgacactgcaatacatactttatattagatcttcagaatatattcatcctgcaaaactaaagctttgtaccctttttaaaacataatatcctaatttccccaactgctagtcactggcaatgatctttctatttcctatttctagaagtctgctgttgttgttttttaagattgcacatataagtgagatcatgcagtatttgtctttctgtgtctagcttattaacttagcacaatgtcctctaggtacatgtgtattgtcacaaatgacaaaatttccttctttttaaggctgaaaaatattccactgtgtgtgtatatgtgtgttaatgtgtgcatgtagcacatttctttatctatccatgaacacaaatactaaggttggtttcatattttggctattctgaataatgcggcaatgaacatgagagtacagatatttcttcaacacattgagctcattttcttatatgtacccagcatttagattgctggatcataggcagttctgtttttaattttgtgagaaacttccatacatttttccataatggctgtgccaatttacattcccaggagcagggtacaagtgttcccctttctccatatcttctccaacatttatctttagtctttttgatcatagccattctaaaaggtgtgaggtgatatctcattgtgattttgatttgcattttcctgataataagtgatgttgagcatttcttcgcatatcttttggccatttgtatgtctccttttgcaaaatgtctattcaggtctttgcaaattttttaatctggttattttttttcttgctacttagttgttaggttccttatatatttttactattaactctttatcagacgcataatttacaaatattttcttccattttgtaggttgtctctttatgcctttgattatttcttttgctgtgcagagatttttagtttgatgcaatatcacttgtctatttttgtttttgtcgcccgtacttttgggattatagccaaaaaacaaatcattgcatagactaatgacgagtagcttttcctgatgttttcttctagcagtttctagttaaaggttttatgtttaaaattttaatccattttaggttgattttttttatatgttgtgaaataggagttcgattctattcttcaggatgtggatgtccaggtttcccaacaccatttgttgaggagactatgatttcctgattatgtgttcttggcacctatgtgaaagatcaattgaccacaaatgagtggatttatttctgggctattttgtttcattggttgacatgtctgtttttatgccagtactatactgttttgattactatacctttgtagtatattttgaaatcaagtagtgtgatacatcaatgcctcaatattctacttgtacaagattgctttggctatttggggtcttttgttgttccatataagttttaggattgtgttttctatttctgtgaaaaatgccattggaattttggtaggaattacattgaatctgtagatagctttgtatgtagtatggacattttaacaatattaattcttacgattcaagaacatggatatttttccatttattcatgtcttcttgaatttcttttatcactgctttgtagttttcagtgtataaatattttaccacttttgactttgttcctaaatattttattttttgatgctattttaaatggaattgttttttaaaattctttttctgtagttccttttcagtttatagaagtgcaactaacttttgtgtgttcattatgtatactgcaatactattcaattcatttttaattctaacagtttttggtatagtctggagttttctgtatataagattatgtcgtctgcaaagataccattttacttctttcttttcaatgtgaatgacttttattttgttcttagctaattgctctgattaggagttcctatatgtaccatattgaaaacaagtgttgagagagagcagtcttgactcattcctgattttaggagaaaagctttcaacttttcactgttgagtgtgttggctttgggtctctcttgtatggcgtttattacgttaatgaatgtacattccttctatacctaatttggtgagcgtctttattacaaaaatatgttaattctttttcacatgttttttcagcatctatttaggggatcacatggtttttgtacatcattctggaaatgtggtatatcacacttattgatttgtgtatgatgaagcatccttacatccttggaataaatcccacttaatcatagtgtatgacccttttaatgtgctgctgaatttggtttgctagtatattgtggagtttttgcatctatgttcatcaggaatatgggcctctaattttcttttcttgtagtgtttttatctggctttgttgtcagtgtaatcctggccttgcaaaattagtcgggaggtattccttcttcttcttccattttttgaagagtttaggaagcactggcattctttttaaatgtttagtagaattcaccagtgaagccatcagttcctagacttttctttgttgggaggttttgattactgattcaatctccttactcattattggtctgttcgaattttctattactttatcatttagttttggtagagtgtgtgttcctagaaatttaaccattttttcaaggttatctaatttgtcaacatataattgttcattatagcctcttatgatcctttgaatttctgtggtaacagttgtactgtctttgctttcatttctggttttaattggatcttctcttttttatcctagtctaattaaaggtttgtaattttttttatctttccaaaacaccaactcataatttcatcactttttaaaatcattttctcatgtttatttcatttatttttgctctgacatttattatttccctccttctgctaattttgggtttaatttgctcctcattttttagcttcttgaagtagaacatcaggttgtttattcaaaatctttttcctttcttttctttttctattttattttgttgagagagtcttgttacattacccaggctggagtgcagtcgtgcaatcatgggtcactacagcctcaacctcctgcattcaatggatcctcctgcctcagcctcccaagtagctgggactacaggtgtgggctaccacacttggctatatatatatatattttttttttttttttggtagaaatgcggtttcaccatgttgcctaggctggtcttgaattcctgggctcaagcaatctgcctgccttagcctcccaaagtgctgggattacagacatgagccaccatgcctggtttcttttcttaatgtaaggatttattaaatttccatcttagaactgcttttgccgtatcacatgggtttcagtaggttttgtttccatttttatttgtctcaatatattctttaatttacattttaattttggcttttatccaatggttgttcaggagtatgttgtttagtttcctcatatttttaattttccaatattcttcctgttattgacttctagtttcatgccatttcggtcagaaaatatatctaatattatgtcaatcttcttaaatgtgttaaaatgtgtgaactaacatatatattctggagaatattctgtgtgcccttgaacagaatgtgcattctgctgtgttggatggaatgttctttatatgtttcttgtgttcatttggtcagtagtgttgtagaagcccactgtttccttattgattttctgtctgtgtgaagataatggggtattgaagtcccctaccgttattgcattgtggtttatttctcctttcagttcagtaaatatttgctttatatatttaggtgtgccaatatttggtgcgtatatgcatacagtttttatatcctcttgatgaattgactccattatcataatgtaataaccttctttgtctattgtgacaggtttggacttaaaatctatttcatcttatgtaagcagagccaccctgctcttttttattattatttgcaggaaatatctcttgatttctgtaaactttcaatctatgtgtgtccttcaagctaaagtgagtctcttttaggaggtgtatagctggatactgtatttttatccattcagcccctctaggtcttttgactggaaactttaatctactcaaatttaatgtaattgttactaggacaggacttcccactgttattttgttgttttctgactgctttgcatttctttctttctttttttcctctgactgtattacttctgaattgatggctttttgtgctgctatactgtgattcatttctcttttgtgtatctactacagattttctttttggttatctggggatgatttaaaatatcttataattagaatagtcttttttaaagctgataactttgactatagataataattctacacttttacttctcccacattttatgttattgatgtcactatttacattttttatattatgtatccattcacaaattactgtagctatgggtttttaaagttttgtttgtctattaacttttagaccagattaaaaataatttatatactatcactacagtattagagtctgctgaatttgatgatatttttacctttatagggagttttattttttactttcgtatgcttttatgttaattagccttcttttgtttcaacttaagaactctagcttttcttttaagttaggtctgatagtgatcaatttcctagctttcgtttgtctggggaagtatttttcctttattactgaagaacagccttgttaggtattatacttctagttggtctgctttcttttatcttttgtttttatctcatttgatatgtcacatctcctttcctggcctgcaaggtttctgttgaaaaatgcactgaatgtcttacagagatttcctttgtgtaacaattcactcttctcttgtcactttcacaattaattgtctttgacttttgaaaacttgattataatgtatctccatgaagatctttatgtttaatctatttggattatttgggcttcatggattgggatgttcattttcctctccaggttgggaagttttctgtcattatttctttaaataagctttttgccctttctcttgctctactcattctgaatcttgtataatgcatatttggctttcttgatggtgtcccataagtcctgtaggcttctttcaggttttttattcttcttacccagatcaagtctgctgttgaaattttacccagatcaagtctgctgttgaacccttgtggctcattgagtttctttaagatgaatatttaaaattcttttgtcaggcagcttgtagttaccaatttccttagggttggttactggtgctttactttgatactttgatactatcatgttttcctgattattcgtgattttatggctttgcttgatgtctgcttatttaaagaaatggcagctctttcagtcctcatagactactcaggaagggaaaactcttcacaagtcagcctatccagagattctggatgaggttcaggggcaggctggatgttagaatactccaacaggctggcttggtgcctgggtcagtgggtaaacattgctggcacctgggcccacagggctcaaccaggcgccaggctccacagaaacaggccttgtccctaggccttgtctcaaggcctgaagccttggaccgtggggcaggtatgcctctggaatgggcttagaacttaggtccatggggtttaactggagcttgggtacacaggagcaagtctggggccagagtccactggcattggcatggttctgtggttgacagaaagtggagtactcgtttcactcttctttcccatgtggaggatatctctctccatgttgtgctatatgggcttggacaaactagtgttgcgtgtaaggggaaaatgttctttctgccctctttaatgtatgtttgttctcttatttctgtgttccactcaggtgctataatctgtcatccagattccttagctcttgtgaagatatctttgcatgtaaatgattgtttaaattcatttttttttttttagagggggagtctcgctgtgtcacccaggctggagtgcagtggtgcaatcttggctcactgcaacctccgcctcccgggttcaagcgattctcctgtctcagcctcccaagtagctgcgactacaagtgtgtgccaccatgctgcactgatttttgtatttttagtagagacggggtttcaccatattggccaggctggtctcgaactcctgacctcgtgatccgcccgcctcagcctcctaaatgctgggattataggcatgagccaccaaactcggccacttaaattgatttgtatgtgagggcaagagtgctgccaactcctattctgccgtcttgctgtcacttgaggagtcccctgatttccctatatgtgatctcctctacatctccagctgtctggcccaggctattagcactatattgtctaacaattcgttaagggccctattgcctaatcttaataattgaatattaacatctgaaataactacagcttcctatccctctatccttattgctattatgtctgaaatctctctggcattaagtttatcttaccctcagggggattagatttttgaatactgcgatgtaaatgaaattttaaaatacattcaattaaaatattgttatacttgaagttgaaaactaaaatgacctctttactttttattatcctctcagaaatatgcatctcctctgtgttagacttctgtcagactgcatctatggggcttctcttgtatgtgtccatttgtctcccaaatatacagtatgtgcctttggtttaggtactacttgccagtatcagttatgactaggttaataagatcatattaaaatgaatgatagtttatgctcagaaaacaaagtatgcctaggttataaaggttatgtgttatttataactgtccaatgcaactaataaacatttccctgacattaagctgtttagactcaatattatgtgggtctcacttttgctgatacaaacttgtgaagacgaagagaaagaaggagtgagaggtacaaaagaagaagtaggaggggactatattctatagatgaaaattttcgatctagaggaacaagtagcttttctgaggctacagaaccaagagaaaggaccaagatttgagttgaaagcattgtacctgccttatactctcttgctacatccggaagagatttcagattatttttatcatgctttcttcacatcctcaatccaacctcaatgaaagtattcagccatttgttgagggtgcaggaagatatacacagctagtgaattactggacaaaatgaatctatttctctgatcttgatatcacatgatagaacatagaatttatcctcattaatgaggaagggtgctatttaaaatggaccacagaatatagaatcagatgattgcatttgagtttcaactcagatatacactagataaaatgttagttacatcacccagcaaccctgaatcttactcagtttaaccatatgcatgttaattagcattgatctattttaaactgttgtaatatatattggaaagtacttctctatatattttatcaaccctacatatacatacatagagtactttatatatttcaattattatttctagccacttctagttacctaaaaatctttctttctgtgcaaaattgtgtctctgtttgttttcctccatagcaaatgcagcagtgtgtgatcaagtatattctaaaagtaaaataagaaataaaaaatagaacccatctgagatttttcctctttaccccatcttcagcccttccataataccttgtaaggaattttcttaccatgagtattcacaaattcggattcattccctagagttaacaatgtccctagcactgggtagtgtaaacaactgggtttttcttttaaacgtggcaaggcaccagtagaagttggaggaagtcccacattcaattcattatagtaacgatataaaaaattcacaaaattttaaagtaaataataagttatgaaaaaaagacaaatgggcacgacaatgtgaagaagtctgaatctgttgtcagaacaaagcaactttcttaaaactgttctccattgcctgggtaagaagtatttgtaatcaaccagcttgaaaactcctcttgaaagaagatgtaaacttgaaacaaaaatgaaaacattcccatttaagccttggaaaaaataaaataatttagttagaggtgttttagtgattaaatattttaatattaatcaccctcctattgctactacacataatgcaatcagcagagtcaatatgtgtatactcttatgatgataaagatcaagacatagaattcaattaaagacatttcactctacttgcagcatctcccttggcccctaattaagtgggaagaaagaaaaaaagaataagaattcttgaaatcttttcagagcactgtgaaacacgaagcacatccagagattacttggtcacctgtatgttgttgcaaaagtaagaataaataacaaggttaaaataatgcccttgctaaagactttcacgtgtaaaaaataatataatgcatacctactcctagatcctgaacttaatgttaattctctctattgattcattcaccagagtttgtaaaaaagcccttcatctttattacactgtcttctcatctcttttttttttttctcctcttctccgtgcagctaagcttttagtatggttatttgcacttttttcttcactttctcaccttccatttcactgttctgtaaactgcaatcaggctttgagcatgtgctccaaccccaacaaacctgtcgcagcaaagatcactgaggtcctattaagtgtgagacacagtgcacatatttctgtcctatattcttgacctttctgaagctcatgaaataattctatgtgccagaaacccttatttctagctttttaaggtagtgttctcttatgattctcctcattctttattaatcattctgtctaaatactggccaagttttgtctatttcattagactttgaaagaactagcttgtttgttttatttgcttatctattgaatctttgctttttactgaatcagtttttacttttatctctcatattatcttcctcttccacatactctgcattactgccattttcctaaatttctgagttgatctcttagctcatttatttttatgctttcttctttcctgggacttctttcttagtactttcttcttttctagtacttgtattatagtcatattgatttctcagctcattaatttttaatcttttttgtagtacttttataattttccctttaaataccacttgaaagcctctcttaaagttaatctacagtattttatttttatttccattctaaaataaatattttatttatttatttcattttgatagtttagaatttccaaatgtatgaatacttgaagtgctattttttgtattttataaaaaatattttaagtgggaaaatgaaatgatctgttttacatgttttaaaagattactcaggttgttatgatagttaatggaatatagccagagtggatattttgaaaataaattggaggttattgcatagtttgagagattaggatactcagtaaaggcagaagagatgtagacagattcaaatatgcattgaaggtataatggacaaaataaatagtagcatcaagaataacattaaagagaaaagtgaggaaagggtgagcaagggccagggccaataagcttctccttggtttttctatatgtatctcttctaattaaattatgagaataactcagctgggcacggtggtttacatctgtaatcctggtactttgggaggttgaggtgggagaattgctggagcccagaagtttgagaccagcatgggcatcatagtgagatcctatctctaaaaacaaacaaaatcaccaggaatggtggcatactcttgaagttctagctattggggtggctgaggtgggaggattaattgaacacaggaattcaaggttacagtgagctatgatcttgccaatggactctagcctgggtgacagattttttattctgtcatttattagaataaaataaaaaaatttattctgttactagaatagaattttattctaatttttttaaaaaattagaataactcatattagttctaggctttctgttacctgaacacgaaatgcatttacgatttctaccctcaacaaaacacagacatttttattagcttggaaaacagactgtaagtggtgtcaatacaaaagaatgccattctttatttggaagagtctctgagtagcataaccaaataaaccaacggactatgatgtgtgatatggtttggctgtgtccccactcaaatctcatcttgaattgtagttcccataatccccatgtatcctgggaggcacatggtgggaggtaattgaatcatagaggctgttacccccatgctgttctcgtgatagtgagttctcatgagatctgatggcttcatactgggctttttcccctttgcttggcagttctctttcctgcacccctgtgaagaggtgtcttccatcatgattataattttcctgaggcctccacagccacgtggaactatgagtctattaaaccttttatttacttatttttttgagatggagtttggctcttgttgcccaggctggagtgcaatggcacgatttcagctgactgcaacctccgcctcccgggttcaagcaattctcctgtctcagcctcccaagtagctgggattacaggtgcccaccaccatgctcggctaatttttgtattttttaacagagatggggtttcaccatgttggctaggctggtcctgaactcctgacctcaggtaatccacttgcctcggcctcccaaagtgctgggattgcaggcgtgagccaatcaatgtgtctggcctaaaccctttttctttataagttacccagtctcaggtatttcttcatagcagtgtgagaatggactaataaaatgagtaaaagttgacatatttaacagaaaaatttcttctaactgtgaaagggattaatataagttttattcaacattcacatttttgtagaacagtacgactttgtgataccatgtattcaagtatggttgaatttaatttttaaaggattaccagaataagaagactgtgtgttaagaatagaggtaatcatgcttggagaaggtattttggatgagaagaatatagattagttttgtttgtacattataactttttaaagttaagagccagtaaatagtctggattaaacactttttagatttgttgactaggagaataattaaagacatgttttcaaagactacagatgaaatttataaacagctgaaattagggggaaatgcaacaggatattctctgccactttgtcctatagcttccttgcataatccaagaacatttaatcagttcaaatttgcctgaatggaagagaacaagaattgctagagggtgaaaggaatgggagggaacaaccccagagacagcaaatgcagctgcagctctccaatggcaacaagtgttatggaaatacgcataagcacaatcaagtctatgtacagcaggaacttggtctttggtgcaaaaaggaacagacttttcacagttgatttaatttgtctatgttataaatggaatagtaatcatataaaggaataaaaaagaatccatagccctagggtacgtgtgttgcttcaactgtgcctatccctcaaaaacatgtaattcttcctaggaaaatctgcagcttttgaattattattggggggcactttttttcaaaacaggaaaattttgactcttaaagcctgatttaagtcctgctctaatttgtaatgtagatttcagatggctttgtctatgaaatttgttcaatagattcaaagcaaccattctatacagtgtaactttccttgttgaacatggtttaaaaaaaagccttgaacactcatctctgtctctcctagtatagagaacagattcacaaatgggcattgactgtctctgtcctacttaatgagtttcttcatagaaaggcaaaaggtgaatacaacacaaagacgatagtgcaattatgtgtagaaattgttgacataaaaaagcctattttatatatttatgagcaaaaattatgtaaaaatgcaatactggcaaattaacaaggtctattaagttaacctcaattaaatctttcgtgttcattcaaaatatagtaaattctcatctagtaaagtttctctctctctctctctctctctctctctatatatatatatatatatatggttttgttttgttataagacggagtcttgctctgtcacgcaggctggagtgcggtggcgtgatctcggctcactgcaacttctgcatcccggcttcaagtcattctcctgcctcagcctcccatgtagctgggattataggcgtgagccaccacatccggctaatttttgtatttttagtagagacgggttttgccatgttggccaggatggtcttgaactcctggcctcaggtgatccacccacctcagcctcccaaggtgctgagattacaggcgtgagccaccgtgcccagccaaagtcaatgtatttcaaatgttcattgtcattgcgtttgccttgtaactatagatcacgggtggtgcccagtgggtagctatggggttctcttttctggttcgtaataggaatgtctgacattgtcattgaaacattaaaattataggaatgttttattgtttgctaccatttctctttttacctctgatccaatattaaatggtgttcctcaatttcacaagcatgttatgtaaaataaatacatttcaaattgttgagcacttttatcttctgggtttgaaattattcatgtcctgactttgaaactttattgcagattaaaaacaaattaaaacacatatacatccctacatatgtgtacacacacacacacacacatgaacacacacacacacacacacacacacacagttgaatttgcttaggaaagaaatccatcaaaataaataattcatgttgggatggactgaaatctagtcttttaggaggtgccaacagatggtttacatttatagaatgcacacttgctgacttccaaacagaaatgaaaattcataaagtatatcattaggactccttataagcagcattatgattatggtatgaatttggattttcccaggtgaagagttttccatcataattttactaagaaaaagtgaaacaaattactttccagttactatcttgtgttagcatgtttgaaatcaaaccctgctgctgatcatccagcagcacatgccaataaactcagacctcaataaggctgttgttctcatgatgatcatcattttataagaagtcttgggcatttttaatcctttaaataataggcattattgcaactaataaaataaggcagtttctttagctttcacttcctattacatcagttaggttaggaactttctatcggtataattaggggtgagacctcagcttattaaagttcaggcaacaaggcacttttagttaattttagcaacccttttggtttaagtagagctacttaataccgtgggataatagtaacattttatttttagtaaatgttgctgctcaccaaaatgttaacatttatatcaggtaaggttataattaaaacttgttttacatctacaaaaagctaattcattgctcatgaagattttgtctacacagtacaaagtaaagtggattatgattggttatacatttaacgaaatcaaagagtcatgaaaatcacttaaaaccaaaacacgcctgagattttattcactaagtgtgtctagtagctcacttgatcaaattagctgaataaatgacaaaccctatccagaatggtagtatttacaatatggagaatataagaaaacataaaaaaattaattgggcaattgctagattttcttaatgatattttaaccggtctaaattatgcaggcaattgttttcagtctctttttcaacatgttgggttgcccactaccaaaataatttagacaaatattacggtgggaaaaatctgtcatttcagtgaaaaaaaaaaagccaaactataaatgttttgtatcatagaaataaaataactagtgttttaggctgaatttgttgtttttaaatcaatgattttaataatgtataggtggcctcttcatatttttatgcagaaatacctaagtgttggcatagatcattccaagcaaatacaatattctccgtctgtaaactttagatatcatatactgtacagtgaaggatgagtgaggaacagaacttttagacacatttattcaacaaaaacacctaaagttgatatttttgcctttccagtgattgacttgatatcctcaattaggggaaaaactagatattatatttggattcaattaatccataatccattcaatatatagtctatacatgactaaatataaaataagattgagcagcactttcttgcttaaaatggatataggaaagaaacaaaaacatagtttatatagatataatttgtgacgttttaacagaggtaaaataatctggtgatatttttgaattttatatggtagaattcaatattttaatctgtcagcctgattcttttacgactagacacaatattccaaaagcttacattccatatttttcttggaaagcaattggcattaaatgtcattaagaacacaaagcagaaataaattcttccatgtacaactcctcaattaaataccttaacagcaagtcatgataatacgattatgcatagtgaaatgtgctatacgcactgcagaagactttgaatgaatcctgggttgtgtggtgaataatcaagaagatgtatttatcctatcttgtcttaggttaggagaaagtataagtaaggcagaggggtcctctggaatataggagcttccaagataatgacgtatcagttgaatttgcagcctaaaaaaggaaacccagtagtccaatggtcttgggtagaaagagtttagcataattgagcccacgtagaatttacgttgtagaatggatggtactgtggtttgaatgtttatgtcccctcaaaattcatatgttaaatgtgatagcattaagaggtggtgcctttaggaggtaattaggtcatgagggtaggacttccataaaagagattaatttttttataagagacacccaggggaccttgcttgccccttctactttgtgaggacacaatgaaaagaagctgtgtctgagtgagagtgagagcacaggtcctcttcagacattgaatctgcctgggccttgttctcagactttccagcctccagaactgtgagaaataaattatgctgtttaaaagccacccagtatgtgatattttgttacagcagcctaaacaaactgacacagatgggacccaaatgtagttactgttcctagaagaatagcttggaagatttctgagctcagagccaggcatctttctcagggctattgcaaaggccagtccaagaggatgaaggggcaagatagggagtgcatgtggaatgataaactcagaattagggccaaaccagctccaactaatcagaccactttaaagtagaatcagactgcagcttagaacactaactgggccagcagcagtaaactgaacaagggtcattgcccagggaaccaagaaaatcagaagacgttttattaaacaaatcattcccaccaagaggtagcttgggccacaattctcccattacacatcaaggaagattccttccttccttggaaggaatctgaggactaagatgggtagttaacatcctgaagggctgcacattctatcttagaaatactatgcattatgtaaagggattcattaagaattggaataaacatgttttaaagtaggtaggactatatcttgtttttcttccccactactcagcaaatggaggtaaattcaactagattaattattgataacataaaccgttttctatgtgcccgagtaaactgtgagtttgcaaccctacaacagcaggtagtattactacgattgtcatcacctttttcattgtattgtcttacagtttcctttcaggctagtatttctaatacactatagctatagctctctttaaaatattttggtggatacataatgatgagatgaacctttgctttttaaaacctatttatctccctaagctcatctattgcaattttgccccaacccacaactcattttccagccaacttttagattgctattcctgaagtatgccattttctcttttgcctctgggtttctgtacatgacatgctctccttacatgctatgcatggctaaatcctgcatatctgttaggaatcagttcagatattaccttttccaaaaatctccctaatttatggtggccaccttcagaagagcaacattctttcttgctcttgaggactcctcagaaccaaggttgagaaatgatcatttttgagaacattgtagattcataaagttaaaggcaagatcttcctaatctgagaactccactgtcctaagaattgctacttgaggtttctttatcccttaggcaaatcattttttattgtatttgtctctttggctaaaggaatcctttatgttatatgccacttcacacactggaggtttacactgaaacatgagagttaagtctccaagtaatgctgattatttattcttaatgtatagcaaggcttctgtatgagcagagtcctggcatttagaaaaaaatcttttgcggaaatatcaagatttttgtaatagggagagcctctgtggtttgaagtttgtagagggagtgcagttctatttttgaaatgtatccaggacttccaacaggtagagtcacagagctccatgtgatcaaatcagattcatcatgaattgccagtagtaagatgagggacttaatggtatgaaatagacattggtagatgacagtggattgactgttatatgttctgttctttattgtatgatgacatatccaggtgaagcagagaaacaggaaaagataattcacagctcttcttaggattaatgcatttttatcagaaatttatctgaaatagccaaaccacacgctttcaggttggccctgatttctatattaaataggccctaaagacaaatgaaaacaaccgcttctggggacctcagtagcctgattgtgacacacataggcatgcctctgttgctttgtttttttaggcagaggtcctaagagaatattgttaagtcctgaccataattaaatatctcacccacagtagaggctccactcatgagtactagagattattaatgaacagggcctaaaccttaagaaagtcaagcaacttctatttttgcaatttttagatctatgagttgccatataagaagtctggctgttctacacagtgccttttagagaagtcatgtggagaatgatagtccctgagacaacacagaaagaaagagaggtcaaggtgtgcaagcatcccagtataggtggcagctatgtagatgagacatcttggatatttcagcccatttgtgcacccagataaccacagccacagccaacatcactagaagcagaaaagctgccaaatttggcccaataaatgcacaaaatcatgagaaaaatgggggttgttgttttaaactactaaaatgtgtgaagggttgtcatacagtaataaataactgaaacaaagactttaccagaagtagggctttgctgtaacataaataaaaaatatatggcatttgctttgtgatggacactggcagaatctgtaaggactttaagtagactgtcagtaaaagctggagggacttcttttttcaggtttctgtccccgccccacccaaatttatgcaacagcatcttaatcttcctgtctccaatccggagatcatttttttttttttcacctaaaaacaagtctaaaacattcagagacactcactaaacactaaacaatatttttcagtttcatacagagggcttcagggtttggctcgggcttacttctctgatcctactggttagcatacactttctcaatttggactgctgtcttttctcttgcattcttttttttttttttttttttgcttagtagtctcattcagatattacccatcttaacattaactagccatgcttttctgctactctcccgtactgtgctaattgctccagctagcacatttccccctaatcctgtgacagtttcatattatcttctttctattgtgtcttctacatcccttccttggccaggctaattcccacatgcccttctggtacttcttttggaaaacctttacccacttctctaagaccgagttagatgacttcttcatatattccatagtatctcatccttgctctaataattacatttttttaagctatggtataactacctgttcatatctgcctttcccttagattctcagaatattgaaggcaagaactgtgtctgtttttcaatataccctcatggttgacaacagtatctggcacataggaggttctttatcaatatattttaaatgaatgaattaaaaatgaatagatgattgggccaagtacttgtgtacttttttccaaataccatgcttattctggcaaagtaaacatatataaaacaatttccaaattggggtgtttatgtgaattttagtttgtttcttatctttactgcaagggggttatatagtaagaacagtggcgaaagagggtagcctattttgtttttgaagcatcctcttgcccctgccccagactaagtcggtaaatgctactgagtgcatgttagtgctacataaaaggcaaccttttctgtggcggcctgttccctgtgctcgttcaattgttatttttataaggcaaatagctatcagtgtgtagagaagccatcaagctcttatagctggttttaaaatactgtttttagtttgtatgccttcaaattgcgcctaaataacacagttatttttgactgattgattctaagaattttgctattacagccaaactatgacattttgcatcatatatttttagcatttttaaagaatgaaatgcatttctattttttaaaatgattttttcattttgagtttgagccaaatatctcaaaaatccacagctcctagaactcaacagaaaatttgcaaggccaaataaaatatatgtggcttactgctgcagctgtatgttttaaagaaagctaatatattgactaattcttagaagagcatccataaattgctgtctctgaaaaatgtttatagttataaaggctagagatgatgtcatttttgctgttacaggtaaagaggcatctgtgtttttgaccttttaagtatttctattgagattctaaataccaacgtaccaaaatacacctaccattatttatccaacaacactcaaaataaaatgacaacattttgtcattccactctatcaatttatgtctctttaaccctttgattgctttaatggttcagttgcttttaatacacaaaggaatatacaattgtttaactaaatagacaatactgtttattttaatataaccttataaggtgatcattctgtaaccaatttctttgatattaatgatcatcactatgttaaaatacgttaatacttaagcagactgatgtacataactgtaacaggttttttgttttaatttctttgtcatctaaacattaccttatattttaaagccaatttgttttgtaatatagataatgaacaagttggtttccccctagagatgtctatgatacgtgaaagatgtttgtgaatgaatacatgtctttgtgtgtattctatggtgtgacagattaaaaatgccacaagttttttgatgttttttctatcaagtcttagaagattctatgactgctttgaccaaaagaaaaaaacagaagacaaatgccaatttctgggccagatcttaggagagtggcggcctccacctcctatctcaacacttggtcttggagccctgagaaactgtgtaagaaattcaactagctattcagctacaaaaatcatgtgaagaggccctgaatctacatgaagaagaaggtggacctaggtgaactcagcctttcagacctgtgctaagatgccaagtgatcttgtcatgccacgtagagcagaaagatgactagcccaattgctggcccagaaaaccatgagttgtaataagtgcttattttttttttctttttttttttattatttattttttttgagacggagtctggctctgttgcccaggctggagtgcagtggtgccatctcggctcactgcaagctccacctcctgggttcatgacattctcctgcctcagcctcccgagtagctgggactacaggcatgtgccaccatgcccagctaattttttgtattttttagcagagacggggttttaccgtgttagccaggatggtctcgatctcctgacctcgtgatccacccacctcggcctcccaaagtgctgggattacaggcgtgagccaccgttcccggcctattgttttaagtcactaaatttcaagggatttgttatataaatatagataactagaacatagggtaaatggcatgaatatctgaggtgacaccccattttatgattctttttcatcaaactattttagaacaattctactaactaggttacaacaagataaatatccaaataccataaaattactcacaagggtacaaagaaatattgaaactattaagtctataattccatggttaatgaaaaaatcaggattttgccagccaagtattatccagtttctatattcgttttggagatgagtcaagtctgctagcttactatctagctcactgatctaaccactatatagaactacatgacctctagatttaaaaacctttatcttaaacattaaaatcacacacacccatagtcactgtaccacacacacacacacacaccacacacacacactgcctctcttcaaatatttctctcacatcaccagattataagacattttataaggatgctgtgagattcacccaccacccacaggcagctgctctgaagaggaattaatctacaacagcaataaataaataaataaaacatggaatgaaaaacaacatacgtattttagtatccagatatacctatataaatacatggagatacttcaagcatatgcaaggttattgatttagaattcagcaggaagaggtacccaaagagttctcagaataacaatgtaaaagcacatgagaaattcttctttcatttgtttttttctaagatttaaaaatgagattagtgcaatttaagaaatgaataaaagaaatatgttagaagatgtagattctttggggattcctagcattcagtttcggggaaattttgcctttcctttaaggaagcaggtatatcttatgttggcttagcaatttaatctatttaactcctacaaagcataacttatttagaacatatactggacattttatgtatcacttctgattaagagttattaaaaataatgtgaatagcaaaacattaattttggctttgatagtgtctctgtaatatgtaagagcagtgtattggttatctattgtgaataataagttacctttttgtttagcagctcaaaacaacacacatttattagctcacagtttctgtgggtcaaggattcagggccaggtgactctgactgagtctgtcatgatgattcaggtaagccatcaccaagaagctgaaggtttaacttgggctgatctgattccatgatggctcatttgcgtggctgttggctggaggcctcagtccctcagaggctatcggcagaaagccttagctccttgccatgctgacttttctgtggagctgcttgatctccttatgacatggcagctggctttacccagagtgcacagttaggaagaaaggaggaagctgcagtgatttttacgacctagtttctgcaatcacacactaacacttgtgctttattctgttcattagcagtgagccactgcgtccaccccacactccaggagagggaaattaagctccaccacttaatggaagcagcatcaaagaatctctggacaaattttagaaccaccacaagtaggtttaaagacttgccaagaatcaacttaaatggtctgtttggttctgaattagaggtgacagtgtaactagtgaacattttgctgctatgagccacggttagtatatattttgaaggctatattcttacatttatctgaattcactatttccctgactccacctctgagtcttacaagaatcaaatatatcttctcagaatgcaaccttatattctggcagagcgggaccattataggtcaagacgatagctagatcaggagaaatagtgcaaggctgaaaacaaccagaatggaattgcagttcatggatttagaaacttcctatttcaattcaatctgtatatcttctttattttatttgttagggaaattttattttcactcctgaggaatattgtaatatgattttagtccaaaataaatcttaaaatcaactacacagagaagactttataacacagtttctttaaatatgtggcaaatattcaattatctgtattaaaagcctgtaacacttcataaaattaagacaaggaattaataagtaggtaccttggcaagattaaaatgtactgacctttctcaattgagggtcattgattcctgtgccattcactaagtttattataaggctttttttgcaaaaaaaaaaaaaaaaaaaaaaaaaaagagagagattcctgaatgcacttcacgataagggagttttatatataatgtgcatgtaagatggtagtagaaacagaaaagtaaaattgtcaaaagtgatgcagttctagccttaggttactcagtttctctctcataggctatgctctccgtttctcgaggcatctccatttttagtgcacatatgctgcgttctcttctttctcctaaccaatttcctctgcttactcatagtttctgctctgtcacaatgttagctggcatatgaaccttcttagcctctcttgcctctctttataccttgttgttagcttctaagtcactggtcagcctatggtctgtagtgtgtaatgtgggtcagggtccctcttatcctatcaaccaatcagctctagatggggtagacaggggcacggggtttacaaagcacttccttttcaggaagggctgtggtcacattcattcctttcaaatgtcagttattggtagtacaggcaatctgagtctttgtccatgtggtgcaatgataaataaataggtgcataagttaaaaactatattttggttctcttttctaattgatgatcttaagaaaacatatacataagaaatattttctcatctgtcaaacagaaactcatttgctcatttactaaatagatgtcctgaaggcctattgcctgtgaagccctgtgctggaatttgcgggtcttgaaagttgcttaaggagatttcctgccttcgaaagctttctgtaggggggtggggtagaagggttaggtattcaagcaaacaagtaaaatatgatgtagaaagtgatttttcaagaagagagaaaacttaaacatatggttactggagtccagattaaaactaagtaaatcacagataataatatcttctttcccatcttacagaactactaacgtgttaactgttacaatacaggtacaagcctagaaggatgattttggggagaacagagttctacagaaatacaagctgtcttatgagtaaataataacagaaatcgtttacagggcaatttttttaaactgacttgaatcacatatttttataagactcatatctttttcaataaaatgtggccaaatttaagttcactttcccttgtattttaacagaaatctgaacttccattcaaagagagataacatgagaagcagaatatatagtggtccaaactgtgttgctcactatttttatgatcatgtacgtgtctttgaacatccaaggcctcagtcttccttaaaaatatgagatgattagaccaaagcatcttaaaggtccctgtggccctgtgattctattgagcctgagccaattagtcaaacagttacctgtcattacacaggctgtggtgtacacatacattttagcaccaaacacaatttaataacagggcacagaggccgcaaagcctcctgattctgttccattactaatttatcaggggctgaaagcaaccaaacttaggatcccaggcagacaatggagcctttgaggggcaagggaagcatcatttaaaaggaaagcattaccattctaaaataatggcaaagcacatgaactgagtgctctgaaagagagcactacaaaaaaggtattctcagcttaaatgccccaaacacaaaagcttttagttgggacttagacgggaaaaagaaaatagctcccaataaattggttttaccagtatccttttgtgtgtgctggtgccaagggggcgagggtacaggcaaagcgtgattttccaaaacctagctgaattatgtttcttctttagaacaaaacccaacattttgctaatgaggataaagacagtaaaactgatattcctgtgctattactaacttgggtattgaaagatcattcacacaataattgtaccatgttagcactatatttgcatatcttctattgtctcctttccttgatattttgatttaaaaccagtagataaccatacagtaccatatatgcatatacaacttaataatctgatgtgcaaggcaaaatgagattaaaaactgaacacttcatgctaaccaactgttatttatatgctatttttcataaacaatgcaagatgacagtgtatttatttgaagaactaggtaagttaatggtgtgtcaatttaagacaatataaaacatgtaaaatcttttagcatccccagtcaggtaggcaaggtgtttgttcatagattcttggtactaacactctttttgaaaaattctacacaaatgccaggcatcattattagcaatacatatacgtaaaattataggtttgaagaaaaatctcatatgataaaaaagaaatgcattttataaatctttataggtggcataaactataaaaaattgaagatttagttcagaaaaacctattttccaaccatttttctattgagatttatatctttgaagaagctatgcacataatgacttcaagattcattgcacagtagttatctttatctgccatactgttagcacctccttaactgtatctatggtcactctactttttttgcttaaagcagatgtcctacatgactgaaaacattttctcatagacccattagtgtctatgagacatacataaaaaagtgaatcccgtaagaactaggagatgatcttaatgcatattgttggtttttaactatttagcaatttcacttatcttgcagaaatggctgttgccctaccatccttaagtgaaagataagtttcaattgcaaattctttctgaataatgagtttgaaaggaaaaaaaagatataaaatgtgtaggtttgcatgttgagactagagaatctatttgggggaatacatggaatagttgagtgaaaggatgcacctaataatatctgatatacccggaccaggaaatgaagacaatgtgaccaaatgtgtttgttacactattagttctgaattcattagaaagatcacagtggggtctagcatggtgactcatgcctgtaattccagcactttgggaggtggaggcaggtggatggcttgagttcaggagtttgaaaccagcgtgggcaatatggtgaaaccccaactctacaaaaaatacaaaaaattagctgggcatggtggggcaatcccgtagtcccagctactcaggaggctgaggtgggaggattgcttaagcccaggaggtggaggttgtagtgagccatgatcgtaccactgcactgcagcttgggtgacagagctagaccctatcttataaaaaataaaaaatacataaaaagaaagaaagaaaagaaaggtctgaaacaggatacatgataatatgtttggcaatctcatttcagatgtaacagtaaagatatgaaatgatgtacatatgtagtttatggattcagggtcattgttctatagtcagagccaagatatttatatcaagtactgtgggctttctgatttattacattgttgtattgacacaaggcagaagtgctagttttgagaataatttgggatattagttgaatggtaaattttcacgtgataaggttcagaaaatagattttaactgaatgacaactctacatacaaatactggctgtatctccactggctaagctcatttttcttttgaaaaggtgtcttctaaaactatacagacatgataccactcagttgttactagtaagtagctttaagttcattctttgtgtaatttacttttttaaaatttagttcatattgaggtgagtatgtatatatgtgtgcaaaaaagatgtctgaatatcagtaatttctcattgtactaacagataatcaagatgacaatacctaagtttatttacaaactttacttcaggaattactcttttgaggattttaaattattagaaacatatttgtatttcattgttttgtgggagattattctagacctcatgacaaatgtccctttttgatacacttgaggggctttggctaataggagttcataagttgctttgctcaactgcaagacggttccaggatttacagtagcaggtgattgccagtttggtcaatgaatggctgttagctcctgaatagctcctcaaaagaatgtgacagccccatgatccacatgttcctctgctcttggcactgtactcaggagattccttgaaggtgatacgcagtgatagtttcagtgtttggaaacagcctccaaattttattttattttttctctcggcaacgactaatcctaccttaatccacctggctggagttttcttactaaaatgcagacctcctcaagtcactttctactaaactcttcaatgaatcctagttaccccaaactcaaaattgttggcatggcataaaaggccctccctgcttgcttttatattatctttatcacttgatacctttccgcattaacatcagacttatagtttctcactctgtattgtttctaactttatgtgtgtcttagtttgtgctgctattaaaaaatgtcatagactgaatgacataacaataaaatattcatctcttacagtttagaaggctgggaagtccaagatcaaggtgacagtgaatttggtatctggtatttggtatctggtgagggctctcttgttggtttgcgtacactttcttcttgttgtgttctcaaatggcagaaagagggagagggctctggtctgctttttttttcttataaaggcactaatcccgtcatagaggctccaccttcattacctcatctacacttcattacctctaaaaggcctcacctctaaatcctatcacattgaggattagaaggtcaaatatgcattttttggggggtgcacttcagtccatagcagtgtgtgtgtgtgtgtgtgtgtgtgtgtgtgtttgtgtgtgcgtgttataaatgtgatttcttctgtttgaaatggccttctctgttgtcctagatgaaagtattttccttctttaaaatacagattaaacatcactttctctgaagcatctctctgtcacctctgggcagaaataattcacagtttttatgttaccattgccttgaatatacttaagttctatgtttattctcatgacattatagatttgttttgctttgtattgttttgtttttaaatgtgcatatcttctcatcttaaggcagttaccatatttcatacatctttatagtcccaactcctaatacaggccctggtatagggttgacacacaataaaaagtttttgtatgaatatttcttgaaataatattggattatgagcattcttttcaccaagaatgaaacacaaagtccttggtcacaatttgacatgagcctacttcttcaactaatccaggcttacatttaaatctttccacattttttttccttctaatagcttttcatgcagacagaggaaagcaacatttaacaagcacttaattgcaacatgtgggaatgagtcaaatagtggtcatgtgtggaacttttaatagcgccaattcacatagggtctctgctcgctagaaaggccatgcttcctctgcctcagatatttgacagaagacaagcaacagctgaaacaaatactgtctttaaacaaatcaactagcaattcttaatagtggtaggtttaacaattacataatgtcagtgatgtcccaccagtaacagattagaagaattccaagtttggaaacatctctaaaactaattcataattgccatgatatgatgatgaggccaaattttggcacaatgcaaattttaaataacagaataagctgtcatttagtcctgactttgtacagtaggtgagcgtttaattaattcttatctaattcatagagtaaagaaattactctttactaacataaagacagatttctgaaatcctcttcttgcttttagttgctagcctcacatactatagtgatagacctattcgtatacagggaatatttgggggcttttaatattcaaaaattagatggtacaaagttcatatcactatgaggcaaatcactgaagctttattctcaacttagcacagttccatgtaatctgctctgctaagaattcagcctcagtatttggtaacagaaaaatttccaatgataccacacagctctccattccctaaaaaaaggcaagtaaatctatgcatcattctcattgcagaactatatattttcttacattgtatcgacaccacgcaagccaacatcttttaatagtttaatatttcttgctattgtacttctttcaaaaagtattttctcaaccaataaagacatgataaaatatgaattaaatcaattacagtatgtctacatgatagaatactgtaatgccattgccatcatatttttaaaaacatttccgacataaaggaaatacccagagtacataagagaaaatttttgttctgcaatattatatatacatcactattctacatttttgtagactatacatcatatgcatgttagaaaaattactggaatatatatagtaaattattagagcaatcatgcctaaattgcattactatgaatggtttctaattttttggtgcttttaagtattataaaaatagtagttattgatatttagcaaatatgtgagctactttgctaagatattttatatggattatctcacttaacacaataaccacatgatgtagatactatcatgacctttaatttacagataaaggaagaaaacatttatatttttaaaattattattattgctttataattttacatcttttaatattctttttaaagaaaaattataattgtatacgtatatatgggtacaatgtgatgatttgacatatgtctacaatgtggaatgattaaatcaagctagttaacatatcttttttgtggtgagatgtttgaaatttgcttattttaaaatataagatatattattattgactatagtcactctactgtgcaatagatctcaaaattcatttctaaaaaatatctaattgaaattttataccctttgaccaacaactcgttattcctttcctatacttccatgagttcaacttttaaattttcttagtttattttattttttttgagacagagtctcactctgttgcctgggctagagtgcagtgatgtgatctcggctcactgcaacctccacctcccaggttcaagcgattcttgcacctcagcctcccaagtagctggaattacaggtgcatgccaccatgcccaggtaatttttttttctttttttgtagagacagtctttgccatattggccaggctggtctcgaacgcctggccacaagccatccacccaccttggcctcccaaagtgctgggattacaggcgtgaatcactgtgcctggcaagagttcaacttttttagattccacatacatgtgaaataatgcagtatttgtctttctttgtctggcttatttcacttatcataatgtcttccagcttcattcatgttgttactaatgtcagcgtttccctctttaaggctgaatagtattttattgtatacatttacaacattttctttatccattcatctgttgaacatttaggctgattccatatcttaaccactgtgtatagtgctacaatgaacatgaggatgcagatatccttttgacatattgatttcagttttcaatttctttggatatatacccgaggtaggattgctggatcatatagtagttctatttttatttttttgaggaatctctataccatttttccataaaggctgcactaattttcatttcccaccaacagtatacatgggttccgttttctccacatccacactaacctttgttatctttcatcttttttataaacaccattttaacagacatgaggtatctcacagtggtcttaatttgcatttccctaatgataggtaatgctgagaatgttctttgtgaatttgttggtcatttgtatgtcttcttttcagaaatgtctacagattcagtgcaattcctatgaaaatcccaatgccattttggaaacagaaaaaacactctttaaattctcatggacccacaaaagaccctgaataaccacatcaatcttgagtaaaaagaacaaaactggggcatcacatgccctgagttaaaaaatattatgaagcaattgctatcaaaaatagcatagcactggcataaaaacaggcatacagaccaatggaatgggatagaaaaactagaaataaacccatatatttatggtcaattgattttaggcaaagatgccaaaaacacacaatggggaaaggacagtatctttaatacatggtattgggaaacccggatatccacgtgcagaggaatgaaacttgatccctatctcataccatgttcaaaaaccaactcaaatggactaaacacttaaacacaagacctaaaactatacgactactagaataaaacatggggaaaatgttcatgacattggtctggcaatgatttttggggatatgacccccaaagcacagtcaacaaaaagtagacaaatgggattgcatcaaactaaaaatgttctgcatgggaaatgaaataacagagggaaaggacagcctacacaatggaagaaaatacctgcaaattatacatctgatagggagttaataagcaaaataataataatgagaataataatataaggaacacaaacaactcaataggaagaaaataaataacccaattaacagtgggtaaaatgtttattattttaagaaatgaattggaaaggaggagccaagacggccgaataggaacagctcaggtctacagctcccagcctgagcaacgcagaagacgggggatttctgcatttccatctgagatacggggttcatctcactagggagtgccagacagtgggcgcaggtcagtgggtgcacgcaccgtgagcgagccgaagcagggcgaggcattgcctcactcaggaagcgcaaggggtcagggagttccctttcctaatcaaagaaaggggtgatggacggcacctggaaaatcgggtcactcccacccgaatactgcgcttttccgatgggcttaaaaaatggcgcaccacgagattatatcccgcacgtggctcggagggtcctacccccacggagtctcgctgattgctagcacagcagtctgagatcaaactgcaaggcggcagccaggcggggggaggggcgcccaccattgcccaggcttgattaggtaaacaaagcaactgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttggagagagcggtggttctcccagtacgcagctggagatgaaattctgggttgaaaattcttttctttaagaatgttgaatattggcccccactctcttctggcttgtagggtttctgctgagagatccgctgttagtctgatgggcttccctttgagggtaacccgacctcaaaggcagactgcctcctcaagtgggtccctcacccctgacccccgagcagcctaactgggaggcaccctccagcaggggcacactgacacctcacactgcagggtactccaacagacctgcagctgagggtactgtctgtcagaaggaaaactaacaaacagaaaggacatccacaacaaaaacccatctgtacatcaccatcatcaaacaccaaaagtagataaaaccacaaagatggggaaaaaaacagaacagaaaaactggaaactctaaaaatcagagcgactctcctcctccaaaggaacgcagctcctcaccagtaacggaacaaagctggacggagaatgactttgacaagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaggaatgcagaagcctcaggagctgatgcgatcaactggaagaaagggtatcagcaatggaagatgaaatgaatgaaatgaagcgagaaggaaagtttagagagaaaagaataaaaagaaacgagcaaagcctccaagaaatatgggactatgtgaaaagaccaaatctacgtctgattggtgtacctgaaagtgatggggagaatggaaccgagttggaaaacactctgcaggatgttatccaggagaatttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagggctaaacatggaaaggaacaaccagtaccagccactgcaaaatcatgccaaaatagaaagaccatcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggagaacaaaaacaggcaggggttgcaatcctagtctctgataaaacagactttaaaccaacaaagatcaaaagagacaaaaaagaccattacataatggtaaagggatcaattcaacaagaagagctaactatcctaaatatatatgcacccaatacaggagcacccagattcataaagcgagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagctaatgtaaaagaacagaaattataacaaactatctctcagaccacagtgcaatcaaactagaactcaggattaagaatctcactcaaaaccgctcaactacatggaaactaaacaacctgctcctgaatgactgttgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctcactcatttgatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcaggttcaatatacgcaaatcaataaatgtaatccagcatataaacagagccaaagacaaaaaccacatgattatctcaatagatgcagaaaaggcctttgacaaaattcaacaacctttcatgctaaaaacgctcaataaattaggtattgatgggacatatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaattagtcaggagaaggaaataaggggtattcaattaggaaaagaggaagttaaattgtccctgtttgcagatgacatgattatatatctagaaaaacccactgtctcagcccaaaatctccttaagctgataagcaacttcagcaaagtctcagcatacaaaatcaatgtgcaaaaatcacaagcattcctatacaccaaccacagacaaacagagagccaaatcatgagtgaactcccattcacaattgctttaaagagaataaaatacctaggaatccaacttacaagggatgtgaaggacctcttcaaggagaactacaaaccactgctcaaggaactaaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctggcttcaaactatactacaaggctacagtaaccaaaacagcatggtactggtaccaaaacagagatatagatcaatggaaaagaacagagccctgagaaataacgctgcatatctacaactatctgatgtttgacaaacctgacaaaaacaagcaatggggaaaggattccctatttaataaatggtgctgggaaaactggctagccatatgcagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatggggtctaattaaattaaagagcttctgcacagcaaaagaaactaccatcagagtgaacaggcaacctacaaaatgggagaaaatttttgcaacctgctcatctgacaaagggctaatatccagaatctacaatgaactcaaacaaatttacaagaaaaaaacaacctcatcaaaaagtgggcgaaggacatgaacagacacttctcaaaagaagacacttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcctattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagttcatgtcctttgtagggacatggatgaaattggaaaccatcattctcagtaaactatcacaagaacaaaaaaccaaacactgcataatctcactcataggtgggaattgaacaatgagattgcatggacacaggaaggggaacatcacactctggggactgttttggggtggggggaggggggagggatagcattgggagatatacctaatgctagatgacgagttagtgggtgaagcacaccagcatggcacatgtatatgtatgtaactaacctgcacaatgtgcacatgtaccctaaaacttaaagtataataataaaaaaataaaaaaataataaaaaaaagaaatgtattggaaaattatactgctaaaccttacttagtgagtgatattttctcactctgcatccttagagaccattatttctttacattgaatcaaaaataacatgatttactcctatttcctaatatatgcatctcattgatttgaccatataggtatactctgccctagcagggctcctaaaatatactgccattaggtgggtgctacaaagttgaaaaagacgtgcaacttactagcttgtgcagaggcaagtcactgattgagtctgccacaattactgctctaatagaggggctacaaattactattggagcaaagaggtgggaggatgtagtaagtaaatgtctcatacagaaatgcccttttcactggtgtttcagctgctcatcctgttcatctttctcaaggcattacaagtgcagaagtctgagtgaagacaaaaaagcctaaaattaaatatacactgatttagcaaaagccaataaaatattattttcagctgaaagtctcacagactacttcatggatgaagtatcagttgggctgggctcactgaaggttgtactaaactgcacctgataattcacattgtatattaattggacactaatatgtgccaaaggatagatatgaaatgctttttatatttgaaaacaattatgaaatatatttttggaaggtacatctatgtatgtaggaagatgttatataaatgatttagagaaacaaagaacacagttatgagacaaatccatatttagcatatttgagaaatccttggccttaaaatccctaatggcagtcagcatttttggagtaggttcaaatacttaaatatcacatcttctttgtgcttaaaaaaatacaaagaaaaccctgtgtttggatctaccttttctctattactagaaattgtatgcatcaatagatcagtataggtttttgttgtagttgttttctaactccctttagaaggtgacagaaattaaaggctggagatctccttgcctattgactcacaaagtttgcaatgtcagaaatcattatttataattaatgccagtgtacaaccaagcattctcctcaaccagcggctgtctgtaaccataaagaaattttagggaagccctacatgaaatctatcttatagatttcacacaacacctgtgagtcagccttgcccagggctatgtcatttcacttcctatccgtctgaaaaatgtgcctcactgagagggcataatactttggaagggcagagtatttataactgaagacacgccatatagcttcacatgttagcatggtgacgatatcaattttttggcatctaaactttgaatagtgaaagaatacagagaatgtattacttgggtactaaagtctgctctaaaggatgtaagataaatcaagatttggaattggatgttagaatctcttatggttaactatcgctattttaaaatgggaaatatgtctgaattaggaattgggtaaatagtcacataatggaaaagtttgcttgtgaacttatatctgactttgttacttatactcagtacttttctttgccctaaattctcatttttgcagtcctttaaatatgctataaaatacatgtttttcaagtctttctggataggaaactttcctaaatttatggaacattaaatgtctggataatttctgagattccagactgtgtttcaataactgtagttataaatacataagcatattataacttaacatattttggttattattagaattataaaatatgtgccaacaacctaagatggttttagaaaaatgtttcaatggacaaaaaggcatgaacaatatgacattttttcacctgcaaccaacacattcgccacttacattacctttcctattggtcacatcttcctatataaggtgatatatatacacatattaacttttacaacaaaacgtgttatttttggtgtatgtgggggtgggggaaaagcaggcccatgtgatctctaccatttctttcagcattaaaattctgtgactgtgatgtaaactacagtatttttgtccattagaaaagcagatttgtgaacttattattacagaattattaatcagaccctaaagactctagaattccaacataacagaataaaatttaggttttgagcatgttgaatatatctgattttaaaaattgaaactagagggtttaagattttattgatccctctaccatctgtccttttaaaacattttaatgggttctcgggttctacatttcagtgtatctcttctgttaagattagctttatctcaatgaaatcgggtttgtgatgctactttttcttatatctagaatttttaatagaaaatttctaggaatttctaagttgttctaaatgattttcatcatggttggcatttggtaaatgcacaatgaagatttgttgaattaatatgaacttattttcctatagttgtcttttacttatttctaccgcacggtctacatgactgataatgaaactgtgtcactataaatacaagagtagtatctgtggttaatgtgatattagaccctcaacaggaatacacagacaactgatagacttcaatcaaagctttaaagttaagcatgttcttaaactaggtgaggagtcatgaagatggaaaatagaaaagtatctctgaacacatgggtcctgaaatggagctttccagaagttggtgtccaattaccatttaatatttcatgaacatgtttagatctaagacattttaacaattttaattaatagaaggacagcctgccctcacagaagtcattgtgaagtttatctaaaaggtgagatttttaaacataattattcccttgatactgcctcatttccacattagtcctgttggaatacactggaccatataatggagaggaatgacagaaccagccaaggctatgatgcttcaggaatagtgcaaggtttctctgcaaatagcttcttgagatgcttatggttcttatattgttaaaattagaactagaagcaatggcaagtagtatcttattggagccagaaagaccatgttttcttgtatataagaaattatactttgaactacctgaactgatcaggcagaatttcagggtttctagaattcttgataatctgtttttttttttttaattttttttttttgttaaaagaaaaaaaaaaaaaaagaaacaaactaccctgagttttttttttttttttttactgatatagctctatactgctgcaacctgggagaaaaggatcacagtgtttatttttaaataaattttagtgtcatttctgtgttatatttcatatactgaattcaaattcctcaatttaaaaagaactcactcaggtattgattgcaaagatatatttctagtagttatgcctaattgacaattgctgtcatttacttctggccaacttaagagtcccaggaataaagtgcttctttcacttttaatcattcattactctctccttttcctcccttgcaaagtttttcctgattttctttgttttccccttggccatccaccttacaccccttattcctactctttgccttcatcattttgtccttgtagagtagctcaagtcagcctttgattgttagtcagactccatgggcaattccctcaatgttttcattgtttacatgaaagcatccaaatgtatagcaaatagaccagctggaaacctccccacagacagacgcatccaaacaggaggttccttgacgtgttgtggtgggtcagtctggttctgctatcagaaagaacagcccacacccatatgcactgttgctcttgagtggaaggcttgtgatagcatccacatggactgggcctcagccaaaacttagcctttagcacatacagcaatacagaatgatgtgacaacgacagagttttggaatactgtttgtagcatgctgttctttggcatactttttcagaatgtaagaacagatttctcctaattttcccaagacatattgtttattatagaatgaggctttaaaaatgactatagatttgaaggcaattgatcgacttaatattaaactcaatatttagtgtacatatcttggaaatttattttgaaatgttgcattggtgactcgtgcttgaaaaaaaccacctaattttaaatatttctccagggtgtgaaaagggcaacattagtaatgagacaaatagagtgatccttgactctaattagagaaatacagtgaaaatttatcaataaaagtaaaatgcttaaaacctaaagcaaatatatttaaagacatttcacaaatataatattggcagtttctgaacaataataacatatttgctgagtatacattcatgttatacactacactaaaatcttgtttaaaaaataagcataacatttacacattctatttagaagatgatgtatattgtctaataacacacattaaatcagtacatatttttgtcatcagtgatttgaaagaataatgtgttataaatttctacctaattcatagcactatgccataataaagaagaataatactattaaaaaataaccatcttggtttcattttttaaaagtccctttctttacttatcactattgttttaaaataaataaggcaaacataaatcagacatggaccaaaaaaaaaaaaaaaaaaacacaaaaccctaatgaaagcaattctatgggggtaaatgtggtttgagaaacatgtccttagcctattctaaacaaacaccttggtaaaggcaaacggaactttgcaaatcaaatatcatcattagtaagaggaaaaaacagtagcatatttctgcctttcatgcttgttacttcaggtggttaacctgaactacaaactcattacttgacactcaagatgtaggcaaaatcaaatgctatattccaacccaaaatatatgtagcaagtctacagatttgtcatacaacatgggcaacatgcaaccaccagtttaaagggttgcaaccaacttcttgtctatgttcacagacaaactgcaggaacctgacctcaaagcccaaccaggctctggaggaaaagctgtgtgcctcattccaagcaacttcagagtttcaatggatttaagacctagaaagagatctggaaaacaaaagagtaaaaataacatttcttatccctcttgatgaaagacatataattgaattccagagaatgactgattgaaatttttatttgttttttttccaatttgcttatctagtgtagacttcacttatagcctgaaagcctataaattatgagagagagagatacaataccactcacaaaaagctaggttatcctgcacacaaagaaccccaatgtgtttgtggtttacaaccatggagttttatttttcactgatgctcacgtccatcaaagctgagttgtcaattggcttcatctttccttccctcagactcaggctgcctcggtaccctctacctgattattgttggtggttgtgatgtggaaggaaatgacataccaaccacatgttagctcttaaagcttcttcccagaggagacactaactactcttcacatgctattaggtgaagagtctcatgccatgatgaatgtcaacaggtcatacaagcaaagataactgtctcctgtcaagaaaacatctctgtggacaataatatagtttaccacaggtagcaacaggcaccatatattctgagagttaggtagaggaatggcctgctattacggacttaagtagagaatgttggccaggcatggtggcacacgcctgtagtcccagcacttgggaggttgaggtgggtgtatcacctgagctcaggagttcgagacaagcctggccaacctggtgaaaccccatctctactaaaaatacaaaaattagccaggtgtggtggcacacgcctgtaatcccagctacttgggaggctgaggcaggagaatcacttgatcccaagaggcagaggttgcagtgagccgaggtcatgctactgcactccagcctatgcaacaaaagcaaaactccgtctcaaaaaaaaaaaaaaaaaaaaagagaatgttagactgatagatacttggatgagctatgacgtaagtaaggccaagtacaatggccatgaacagcagatccatggtgctaccattaaagtattagggaggaattggcaaagtatcatgctatctaaaaacaggcagatgctattcaaagttaagtatagggagatgaaatattaagcaacttcctttcttgcaaattcaagggatttcttcatttttgacccagatataggaaagaattttatttatgctttaagtagccatgagactgcactgcttgaagtaaaatgaggtctaaaatatcttctcagattttggctctttccttggtaatcccaaaattggtttcgttcagaaatcagtgaattctcctatctttattatagggaatctacagtttttgaggttctgaggacctgatctctaatagaagcttgaactctttctgacatttttgttttgatgggaaaatttttcaatgtaatcacttttacaggacccagacaaaagtcccaaatttaaaattttattctcagaaaatttttatagatttttacagtgaataccaggaatgcatccaacagaattattcaatgaaagcagaaaataccaccattatgagtgagatatcatgaaccctatgcggcaaagatcttgttgccctgaacattttgcttctttaatcatcagctctagttgtcattttagacaacaaggcaaacattggcatagagaagcaggaggtaatatcaggagtttcagatggggtaacttctggaagctgttagtagcttctactgtttacctccttttcaatttttttttcacaaaaaaggcacaatatctgaaggacacatgcttccttttaaagtgtgaatgttatttttagcactggtatggaaagcagcagaaaatacaacaatttatttgctctgttcatgaaaagtgattttatttttgggtttaaagaaataattgtgaatgtcttttgggaaaatacaaattttaaggtttaaattcaagtgtccctttctgtaagaacttttctcatttacgcgttttcatctatggtggatatgacatgattatttatgtcatcttttctccttcctacggggtcttctcttgcaaaatggcgctgcatggtcagcactgactcagaatgtggaacaaggtgaggctgcctttctcacagtattttatgtgtattcaagctgtgaaaagtgtcacagcaatactcccattctgtgtcagctgaactgtatctgctcatattcacatctcggattgactacaattcaaacctggttatttgtttctttatcaattgtcacaaaataaaaggcatattttagcagtgtttttgagcccccaaataggaaactaatttttatagaaatctataccattccgtctttgggagtatcaatccttaaaccagcaggtgagaccacattttattaaatggctcattctaattcagatcctggggtggtcttacttatggatgaattgtgctgctaccccaagaaaaccatttaacctatctgcacttacagagtgcctctgtgtacctgctgctgtctgatttgaagccatgaaatgagaggcttctgtttttgaaatcagtttttcagaggtgctggctttgacagtggctactctttattaaagaaagaacaagacaaataaacagaggtttgaccactacctgtttcatattggccatttctacatgatgcaaaatgccaggtcataaatgagtcattcagtattctgggcttctctggatggccaattcagagactgaggaaactaaaattactgcctgtaaatcattcttaggatgagagagagaaagagggaaaagaaagattcactggatacatattgacatatcctttgagtacatgtataaaaattatattctttatattttacttacagatattgctatttgttaaatatgaacatggtcagtttaatacatgcattatgttaacaaaatttcaattattgaataatttgggaataaagtttcttttataaattcactcacataaaagcaggaaagctctgcagaaatcatgtcaagaagaacagtttacctgaatttgcaggtgcatgataaaaatatcccagtgcccagcttctatttgtacctgcctagatgaaggtaaacaaatgcaactaagatcttccaatgacttctgttttctattgcattgctgggttattctttgtcttctttctttacaaaataggaactaacatacctgtgtctgatttattctccatatgttatgccatttattgttatttaaaaaaaaccacaatgtaaaatgtactcaataaagaaacttgtaagacagaaagaaataaataaaaaacacataaatcatctgtcatgtcatcaccaaaaataactaatggtaacatatggtttgcccttccggtaatttttctgtgtctgtgcctcatctcttccttggctgccttctcttttctatccgcattctttttctaggtgatatcctctaggcatgcctataatccatccttcacaggctagatggagtttacttttaaaaactctccagtttgaaaccctccaatggcttcctgctgcacttggaatacatttcaaagtccttatgttcttcttgctgagtcttttacaaccttcctctctgactttgtacagtctgattttcttgccctcctcatttttgtttgctttctattgctgaaataaattgctactaatttagtggcttaaagcaacacagatttcttatctttttgttctggagttcaaaagtcaacaagaggtctctctcggctaaaatcaaagtgttggcaagctccatttctttctggaggctcaatggaataatccattcctttgccttttccagcttctagtaaccatctgtattgcatggctcatggcccccttcaaaggcagcaatgtttggctcagtgtcaccctgtcatctgtctggtcctccttctgagtgtcttccacttataaagacccttaggattatattgggcccacccagatattccaggataatcttttggttagccaccttatccatctgcaacctcaattctcccttactatgtaacataatgtattcatagattctgaagattaggatgcagtcatctttggagaggggccatattctatcacattctgaagcattccttagagagtcaaagatgactatccactatccctaacttcaccaagcatggagaccctgcattggcccagtgatagccactatgatataaagattaccatacttggccaaatgaataaattgagaagtcagaactgttggaatattgcaaacagtataaggtgagagaaacattcggaggaagtgcaagtttattcagctaaagtttatagggctaataaaaatacttgtttcattgtcctgacatcagtttattgtaattaaccaaatatagactttagctttcttttctttttatagaacttcctcaaaaacagttaatacattttgttgcaacctattatctgaccactcaaagattattgaatatattatatgggatggccctggggatatagttttgaatgagactagaactgcctttcaagtgactcactagtttaatgagataatcagataagtgaccatttaaaatacagactacataggatttagcctgggttttggagagtcttgttggagttcaaaagaggctaagcagaaagagtgacctaatgcagtctaaattagaaaggttcccgaaatttttccaaatggagatgaaccaacaattgaggaagggcatccatcaacaggtatcaaacttcttcctttgttgtatttttccttcccctagaagcagctttatgaaaggctcttacttctctcacctcatcactgtttccccagcatgtagactggtttctggcacatagtaggttctctatcgatatctactgaatatgagaataatatatgtatacaaaatatgcaattttactttatagaaaggaaatcatacaaaatggcctatttggtaacatgtttgcttttagttagcaatatgtaaccatcattgtctgataaccattttgacagaaattcaatctcaaataaatgtttattcaatcagagctttctatgttagatttctttatttataattatggaagaataaacattgtttcctttagttcttaaaggagcttcgggggccaaaagtgtgtttgaattataattctccaaagcctaaaatctgcatttgtttaacaagagtctattcaaagtcctttgtactttaaatctttccttatatctgtttcctgcctgagcttggagctatggatcctggagactcacctattttttttttaatagataggttttctgtgatagtttattttcaatacaactatctcaaaattttgagcatactcttgctttccagtaaataaatatgccaaccttcaaacctccatccacctggttccaagactttttaaaaaattattattattatgttctaagttctcggatacatgtgcagaacatgcaggtttgctacataggtatacatgtgccatggtggtttgctgcacccattaacccatcatctacattaagtatttcttctgatgctatccctaccctagccccccaacccagacaggccccagtgtgtgtgatattcccctccctgtgaccatatgttcttattgttcaactcctacttatgagtgagaacatgcagtgtttggttttctattcctgtgttagtttactgagaatgatggtttccagcttcattcatgtccctgcaaaggtcatgaactcatttttttttttttttcagacaagaatctctgtcaccaggcttgagtgcagaggcacaatctcggcacactgcaacctccacctcccaggttcaagcaattatcctgcctcagactcctgagtagctgggactacaggtgtgtgccaccatgcccagctaatttttgtatttttaatagagacggggtttcaccatgttggccaggatggtctcaatctcctgaccttgtggcccacccacctcagcctcccaaagtgctggtattacaggcgtgagccaccatgcccagccaaactcattcttttttatggctgcatagtattccatggtatatttgtgccacattatctttatccaatctatcattgatgggcatttgggttggttccaaatctttgctattgtgaatagtgctgcaataaacatatgtgtgcatctgtctttatagtagaacgatttataatcctttgggtatatagccactaatgggattgctgggtcaaattgtatttctggctctagatccctgaggaattgccaaacatgagaaagcaggaaaaatctaaaatggacaccctaacttcacaattaaaagaactacagaagcaagagcaaacaaattcaaaagctagcagaagacaagaagtaactaagatcagagcagaactgaaggagatagagacacaaaaaacctttaaaaaaatcagtgaatccagggactgtttttttttttttttttttttttaaagattaacaagatagaccactagccaggctaataaagaagaaaagagagaagagtcaaatagacacaatagaaaatgataaaggggatatcattactgatcccacagaaatacaaactaccatcggaaaatactataaacacatctacgcaaataaactagaaaaactagaagaaatggataaattcctggacacatacaccctcccaagactaaaccaggaagaagtcgaatccctgaatagatcaataacaagttctgaaattgagacagtaattaataacctacaaaccaaaaaaagcccaggaccagacagattcacagctgaattctaccagaggtacaaagagatctggtaccattccttctgaagctattcctaacaatagcaaaagagggactcctccctagctcattttgtgaggccatcatcatcctgataccaaaacctggcagagacacaacaaaaaggaaaatttcaggccagtatctctgatgaatatggatgccaaaattctcagtaaaatactggcaaaccaaatccagcagcacttcaaaaagcgtattcaccacagtcaagtcagttgcatccctgggatgcaaggctggttcaacatacacaaatcaataaacgtaaaccatcacataaacagaaccaatgacaaaaaccacatgattatctcaatagatgcagaaaaggccttcaataaaattcaactccacttcatgctaaagacactcaataaagtagatattgatgaaacgtatctcaaaataataagagctgtttatgataaacccacagccaatatcatactgaatgggcaaaatctggaagcattctctttgaaaactggtgcaagacaaggatgccctctctcaccactcctagtcaacatagtattggaagctctggccagggcaatcaggcaagaggaagaaataaagggtattcagataggaagagaggaaatcaaattgtctctggctgcagacgacatgattgtttatttagaaaaccccatcatctcagccccaaatctccttaagctgaaaaacaacttcagcaaagtctcaggatacaaaatcaatgtgcaaaaatcacaagctttcctatacaccaataatagacaaacagagagccaaatcatgagttaactcccattcacaattgctacaaagggaataaaatacctaggaatacaacttacaagggatttgaaggaactcttcaaggagaactgcaaacaactgctcaaggaaagaagaaagaatacaaacaaatggaaaaacattccatgctcatggataggaagaatcaatattgtgaaaatggccatactgcccaaagtaatttatggattcagtgtgattcccaccaagctaccattgactttcttcacataattagaaaaaactacttcaaatttcatatagaaccaaaaaagagcctgtatagccaagacagtccttagcaaaaagaacaaagctggaggcatcacgctacctgacttcaaactatactacaaggctacattaaccaaaacagcatggtactggtaccaaaacagatatatagaccaatggaacagaacagaggcctcagaaataacaccacatatctataaccatctgatgtttgacaaacctgacaaaaacaagcaatggggaaaggatttcctatttaatatatgatgttgggaaaactggctaaccatacgcagaaaactgaaactggaccccttctttacacattatacaaaaactaactcaagatggattaaagcattatatgtaagacctaaagccataaaacccaggcaataccactcagggcataggcatgggcaaagactgcatgactaaaacaccaaaagcaatggcaacaaaagccaaaattaacaaatgggatctaattaaactaaagagcttctgcacagcaaaagaaactaccatcagagtaaacaggcaacctacagaatggcagaaaacttttgcaatctatccatctgacaaagggctaatatccagcatctacaaagaacttaaacaaatttacaagaaagaaacagacaactccatcaaaaagtgggtgaaggatatgaacagacaattctcaaaagaagacatttatgcaaccagcaaacatatgaaaaaaagctcatcatcactggtcattagagaaatgcaactcaaaaaccacaatgagataccatctcataccagttagaatggtgtcattaaaaagtcagaaaacaacagatgctgaagaggatgtcgagaaataggaatgcctttacactgttggtgggagtgtaaatttgttccaatactttaatgttattttatataatagtaaccaatcctcataactctattccaaatctatcaaattatagtgaggcatggcagtagaaggagagtattggaggaaaggtaagtagaagcagatagaaaaagaggcatttcataatcatttcaggttgtctataatgtatagttttcagaggaaaagtaaacataaaaatgcctagatagaaaagcctgtttaatatgtagaattacatttctgtaacaagaatcccttccccaatgtatcacaatcttctagaacagcttttgataaattttaaagactcaatatcaaatgaatggatagataaattacagaatatattagtgagaggttttgaagaaaaggcagttttgttgcaatacagaaagctaaattaacttaacactacaaagatgcttcatgcagaccaacaagaacaatagttaacagttgaaaacctgtttctgtgttttagccgcccctcacccacaatgtatacccatagtgataacattttcttaataaaaaactgaatcacatcatttgactgaatgaaaaggaaagggtatgaggggaagaggttttggaagaaagggaaagaagccacagtgcatcaactcatgaggaatgctttcacacctgccgcttccctcccactttgttacacatccctgtaaggcgtgcccttcactcctcatttctgagaagcactagccagtgagctatattaatcaaggtattatttctctgaaagttattcagcaaaaaaaaacctttaaagtaaagcaaaacacaaaaaaaatacaaaaaagcaaaaaccttgtatgtagcaccatataaaaatattttaaaatggcatgatcctctataacacgggatagatggccactatatttgtatagcaactacttccagacatacacggaagaatatgttatcatactttaatgatttctgaaagatatctaccaaaaaatagtataaaatactataaaagagctcccgtgtagtttccaaagtccaccaatattttcaaatcctacgttacataaagagtttctttaaaaattgactcgaggaatgtttcctattttagatgtcactatgattttaaatgttaacatacaatagcaaagtgcacctcatttttcctatttcatttttttccctcatcaatctgactttgtttttgtagggagtgctctaggtgaggcatgaacttacagccttggcatcataaataccgtgtactaatcaactgtgcaactggaacaaccagacttttcttaaatggttaatgatatgactcatacattgatacatacaatgatattgttaaaatcacccagtgtatcacttactctacatttaaaagccctgtgtgaaaatgactgcttatttttattagtaattaatcattataaagccatttaatggagttatgtattcttataaatctctgaatacctgcagtcaaatttaaatattctcttagttttatatttcctctctacattagatctttttgttggttttttaaagacatgccacttttgatcttaatattaagcatattgatttacttaaggacatgaagaatccagttttaacaagtgtatcgttcacaaaaatgtctcctatatggctgtactctttttccatttcctggttttgaatagtcttatttctgtcatcaacaatgaactttaaggtacctcatttcaactagagcaaatggctgttgaattcaatgactcactcagcatagaaattcattagacattggtttatcagtcaaagatgacatttgttttgagccagatgggttttcttgaggaaatcctctaactggatgcagattagattggattttagctttcctacactattaaacatcactgtttcatatggcacacacagcctgtaatatatttgtatatatttgacaggattttaatagccatggttttaataataaaagattacactttttctgaagtttatctgtttgcagtctttgatattttatgggttttaaaacatgcatcatcttataaatatatttccaaagcctaaaatcttgggatatatttttaaattaaaatgttaaacaataacaccaaagaagaaaatctcatttgactaggctacatagtaacagtgggatagaatagttgatccacagtgcaacttttcttgggcattggtgtctctatcttttctattttctatatcctacacaccctaacaattggcaagtcatgagatttctacttagaagaaaaaccattctattttcacaaataccatacccagtcaagacatcttcatgtactgcagagacaacagcaatactgatctaatttgcattccatcttcaaatcttactgtttaaattaatcctcataagagcagtcagtaatcttttaaaaagatagattagggaatgttacttattgtaataagaacttggtaatttgggccaatcctaccaatgtggacaacttgtgctgctgtatacatatacatctccagatgcatctttgtgtatatatacatgaataggtgtgtacacacacacacatacacacacatttgaaggcttagaagactaataagagagtaaaaaaatggtgttaccatctggctaaagatggagatctggagaggtgggctactcttgccttatgggttttcactcatttcaggagggttggttgatcaagtgtacagtgcttttgtcagactcatgggactgagtccagggtctaccaaagtatggggcttggcaaatgtccctggtcttgggttgggaccccaaatggcagtgctttagcaataaaagaaaatcagaatcaggcactctcacaaggaccacagctttgctttgattctctccatctctgtaatcctacagagcaaggacgatgaacaaaccaaagccaaagccaacaaaaagcaaattccacaaacatagcatggaataaatgtacctagacacaaaagaatagatactaagttattttatttatttcaacacacaatatataatgtttaggaatgtattcttaggtgttaaggtcatatgaaaaatcaagaaagtatttataataaaaggcaagataatggttcctctggtgtacagaggagagagaacataagaaaatcttctgtgttactgccaatcttcctctattttggagtgatgtgtacacatatgatcactttgtgataaatcagcaagtgtatattttattttgaaatttgtgtacctgtgtgctgtatttatactaagaatgttaaattgtaagttagatcatattactctgtattgaaaatattccagttacctgtgattgtctacctccctgttctcatctggaaacagcctgcccccggccccattgctcgttttactctaggtacatggaattccttgctcttgttcaaaaggacaaaaatcttgcccattttagtctttggacttgaactttcttctcttcctgcaatacacttttattgacttgatccataattgtttcccaatccttcagccccctattaattgtagccttcttagagacgtatttcttgaccagtcattctaaattgacaactgaaaacccaacaaatgctccatatcgccttgtttatttccttcatattggaaagcagatgatgacatttgatttgtaattaatatatcttttatccaaggtaaaatatttgctgtaatgtaagatctatgatgggaggtatacttttggtttttattctcagcactaaatgaatcataggccaacgaaaattattttgagaaaagactttgtgcaattcctaaaaattagtctattataccatgggtggtaggagaagcttaggatctcatcatataatttggttatcctagctatgctgctaagcaaaacaaatatttatttagcccagatatgtagaattatcttagacaaattttcatatgtgtccagtgccagttttcaaaatgacgtctttttatggcaacacctaagtgaagtatttctttcagggacattatacacaaaggaaagtaaatgttttagttcaggtggtaatgacaaagttttcgtaatgatacaagttatttgtaatgctaaagttattgcgtttcatttttacttgaggaattacatatgccattttagaaactttacttggatgtgtatgactgtatttcccgccgtagttagtttttaagaaagaatgtttcacctaaagccatattcacctttccagagtaaaaaatcaatatttagccttaaattaataaactatgtttttgttattattggtccttttgatactgtatctctttccatttcattaaaattaaataacttacctgccatatttattatctgaatactaatttattttcccatttaatttttttctttactctttggtgtttctttgctcagaccaaacctagtcttgatctagttgcactgtgctttctttgaagttcaaatgcatctaatgaatcatggcagtactctctatcaccttacaggcatcaaagtaaatcagccagaacagggatagaaattccaaaggtccctgccacctgtgctgcaacattcactccaagtaaacacttagtcatctctttagttgtgaacagtgatgtggcccaggagcctttcaccgaaggtggcccagcacttgctgctgagttttcatgcactttgcttgcatttatcgccaccatgaaaattacccaaggattgaaaagtctatcaagtatagaggagagaaagctaacaggttcacagatgcagataatttagtgttttaatgaaaccctggattagataatgcacttctctcttttatttaattttttaatgttacctgtctgctattatacaccatttgttcttatagaacacacacacacacacacacacacacacacacacacacacactctctctctctcacccctacctcaagcaaaggaggttgcaacactttttctcaaaaataacaaatcaacctgtaattcttcacactaacggtaaggtttatgtgtttgcttcaagttaaaattactacctttcagatggattatctttttatttttattttttattttttttgagatccacctaggctgtcagagttccacatttggcatcattacacccagttaatgtaagacagcttatttttatattgcggtgttttatagatttttttattgcaccattaagagcattttgttttctgcaatattcccagattttcttgtcataatacacaacatcccacagtcccactttgtgccaaatctcatagcattcacttacatctacttttctgcctcagaaggctaggtaatgagctgagcttcagaaaaagaaattgctggtttagtttttttgcattacagcccaaacagattgttttcttttcgataactagccaatgctcagttcacagatatttcccctggtaggtaagcattgccgatttagtgtccagtagcatgtttacagttcataaatgtcatctgattttcaatttttaacctgagaaatacaatgtttctttcaatattctgtaaattttaatggaaattttgtggaatttctcagttgttcagtgaagcaaaaatttgttcagcatgcctgttttaatcctaatgaaaactattaaggagtttatattcttgatattgactatttttgacaatatagtattacaaaaccatttcgacagaagcagttttagctttggagtttacacagattattactgtattatctatgactttcattcactcaaagtacatacatatctcataaagacaccatttgagattgccaccatttaaaaaattaataaataatagttgttcacatttatgaggtacatatgatattttcacatatgcatacaatgtgtaatgatccaatcagggtaattgggatatctgtcacctcaaacatttattgttcctttgtgtggggaacattaaaaatcttctctcctagtgattttgaaatatatgataaattattgttaactctagtcaccctactgtgctattgaacactagaacgtattccttctaactgtatttttgtacccattaaccaacctctttttgaccccttctctctgatatacttctcagcctttggtaaacaccatgctacttactacctccatgagatcaatttttttgcttctacatgtgagtgggaacatgtgatatacgtctttccgtgccttcttgcttcatttttgataatattaaataaaggtctaacacctagtggtcaagtttgaggttgacatggaggagaataagacagtcatatttaggctgaaatgattttaaagacaatgaactctctaatgtacatggatatacatttgggattcctattcagggctggaattcaaagcattctaaacatgttaacaacagcatttatttatagttctagtggcttgcgatccatcaaatggcacaattgctactggcctcagggttgacggtcttcctggcagtggtcccacagattgcaccagtgtaatttcaaggccttgatttgccaatgatcttatcattgtaatgatccctatattctctttagctttctcattttataagactgacattagaaagcaggttcatattaacatcatagcttgaccaggtcttaacagacaggatgactaaactaccagtctacttgaatttgttttttcagaggtctatatttaagcttttttccaaaagattaatgttggttagcatgagaatagaagacagtgaaagcagatgaactttcaaggaataaaaagaattcatgagacctaggttaattctagaactttgaagattagatttattcatctagttggtctgaaatctaagtgattttttttctttttttcctcagagataatattcccaaataagatttttaagttcattctaaagcagctaaaattcttgagtagctatctacttatttggactaatttaattttatcccagtgatattaaatatatacacagatacacatatacttaaatatatgaattaatattttcaataaagcaacattttagaagttaaatagactggaatcaatcagcttaataatgcataacaccgaaagaaagtaagaaaggaacaaaataaaaaaacattaggggaaaagcaggtaagttaggagagggatacatgattctacatttccttgttaaggaggagctaattgatttcacaagagccagctggggttttaaatgctcactctttttttctggtcaatattaataacaataaaatcaatgcctaatatgatattagccattaaatggttattccacgttcatatttgggctttcacaaagtcactgaagttttttttctttttttctgagaatctgtggatagtccagtcggtacagtagataattgaaataaagtgttccctgcatcctttggctctgcgcttcagaactgggccatgggttttcttttaagaggcgtaatgttgtgctggaaaccacatcagctttgacaattgagttcttattttcacttcactatacaccaactttatgagccctcatggtgcttaaagtttattaggaaagaaagaaacaaaagcttcaggggccaataattagctaatttcattgtgatttcatgctacgatgcttttggctcttcaaatgtgtcctcttgccccaccaggaacctggaataacatgagcattcctcttccccttagcttacctaatttgttcctgttcttcaggtctcagtttaatatcatgtattctcttacttccctaatcttttcaacagatttggtgcccttagtgtgcctttatcatcagtactttctcattatagcacttatcatactttattataattaccaacttaattttcttttccaccttatttctatttgaatctaccacatttcttggcatataatactagcacaataatattagtagacaatggataaataattgagggttacatttaattgtgtctggactatagtaagaatccaatgcctaataactgtgatcactatctcaaactatacctctttctaatttctaaaacaaaagaattttaatagtatagaaaatgctgatagtcatttaatattttccgacttcaattaattaaagtctttcatagaaaaggatgtggtgttataagctttcatccaagacatttaattcaagttttaacatatttctaatgtatgactaagcatattaattgaatagcgttaaataacagtaaaggttaaagattagaggatgttctaaatgaaagatgagcagttcgctgctgtatatgcatataggcaaagaacagctgggacttctcttaggataaagaaatatgctcaaaactgtacaaataaaatgcagatctttaccacatattgtattgaatgtcaatttacaaatggactaatctgtggagaaatataacatttgtagttaatatgaataaaagtaatgttagacaatttaaagcaggtaatttgtttcacttatacattgctaagtatatagtgtgattttccctgaacacagaattatatcacatagagtttttctttttcttttagaatcataatgtcttagtcaaaatctcatataagctctagctttttctgtcattcaaatattcccacattgactcccttaaattatgtggaagtttccttctccccagctcacatgtgtcaatgaatttatctaaagatcttactggcttaggacttcaagaacaaatatcagtaagaacctttttaaataaaaagttttgaaataacacattttcctgattttaaaagtaatgcaaactaatttcagaaaatctgagaaaattaaaataatgtaaaaattatattatcctgttttagagataattgcttttctttttatgtacttcaagaatgtatatattttaaaagaaaatcataaagataacccgtatagttttatagcaggatttcctcatgtaatttcatgtcataaacattttcaaatgatattaaaattatttaacctcagatttttaatggctatgccatgagtaatttaataatacccctaaatttggacattttcattatttatccttatgcaatgaagatatttgtatataatttgttttctgtacttagcaatttgtaataggtgttttctataatgattatgaaattaaaacacatacacctctaataggatatttctactatttagatactattaaatggtataaaaacatgtttaaaagaatattcaaattacaaatgaaatttttcttttatcagaaatatctttgccaaattttataatagagaaagtaatattgaggcataattatcttctttaatattatatgagtgaatggggatatgcaattagttacaagaccacaaacattaaacaacagaaagttatcagctaaacctaaaaacaagtgtgaatttgtcaatatgaaggtagataaaagggaaatgtgtgggctatattgaggacctgaaagagggactaggcactattaaacctgatgggaagcttaagtgaagaaagcccttagagattatgccaggatagaatgaggtctcctttgtaaaataagtgaaacaatgggacacatttttttcagttccacaagtaggtttctaacaatctcgatgttcttttgttacagcctttgagttaaatagtctgagtttcttcagcttcgaaaatgttaaaataggctgtgcatggtggctcacgcctgtaatcccagcactttggaaggctgaggaaggaggatcgcttgagcccaggagttccagaccagcctcggcaacatggtaaggcctcatcttacaaaaaatacaaaaaatttagccagtgtcatggtgcttgcctgtagtcccagctacttgagaggctgaggtgggagaattgcttgatcccaggaggtccaggttgcagtgagccattattgtgccactgcactccagtctgggtgacagagtgagaccctgtctcaaaagaaaaaaaaagtaaaatactgttttgtttgcaatcagagccctgtctgtctttgtcaccatgtatcagcagtggttagcacatagtagatctccaatacatttatgtgaatggttctatgtaaaagcaaacaccacactgattaatcactaattaaaagcaaaaagcaaaaagcaaaagccaaaagtcctcttatacaagattctgcagccaaagagcaaggacagcagaggaccaggctcagaatctaatcataaaagcagcagatttcaaagaattctggtttattccatgatcagaaccctgatagttgttataatgatacatgaatatctggagcaatgcaatttaaaagtttgaacttctagatttctagattttctctgggcctgcagaagttgttcacttcctcttttcacaagatagtatcttctacccacttgaagtcatacagaggctgacaaagggtagatttcttataggataattcttgttcttcagggattactctcatcactccctctgacaaccagacaaatactgaatgtcaaataccagcacaactgggacaaagatgctatgggatttctaagagagaagaagggctatcattgaagttactgaaggatctgcaggtgcaggaagagtacacagagtatgtagcctaaggggctctgacaaagggtgaaagaatatacatttggatacagtagctaatggatatggaagcactctactatgatattaagatttaaaatcctggcacataccctagatgatgttaacagctgctaggatggtacctggaaaatttatggctcacattgagtgaggtagaaattccagaactgccacggaagatgaaggaagaagggaacaaaggactcagtgtattgagcatgcctgagaaaatatatatggaaagctagaaatcccgcaagataaatataatccaaaggatggaccactggacactccatttaccaaaatataaagagtgtgttgtggagaaggacatcagtattgttgagaagctcagtggtaactgtcttctgaaggccagctggtaggagatcacattacagaacagggattcttgaataaaaatgggaacgatagaatctctaaataatagataccaagaggtgatatttcattgacagaagaaacatagatgtagatttcgcaatgagaaggaagacaggagtggcaaacatggagtctaaaatttagaaaacagtagaataataaatagagtatggagttcctataggcaagacagatggacagctaccaaggattttgattaatttatacaaccaaaaccaatcaagaatggataatcaggaggttaaggccaggcacccttcttcttcctccacaactctctatcttttgcccagtttctagacctgcattgattctcagacttttaattgaagatgactgataaagtagataacagatctttcagggaaagaacctaataataccaggaacatatgaagttgtaattttcccagtccttttccaacaggacctgagactctttactcaagtgactatgtactaggtaagaggaacatccagaacttctgaggtttgcttgattcagaatccaaactcaaattaggccaggtacggtggctgacgcctgtaatcccagcactttggggaaggtgggaggatgctttgagaccaagagtttgagactagcctggggaacacagtgagacctcgtctccacaaaaatacaaaaattagccagatgtggtggtgtgcgcctgcagttccagctacttaggaggttaaggtgggaggatcacttaagcccaggaggttgaggctacaatgagccaaggtcacgccactgcactccagcctggggaacagagcaagaccctatctccaaacagaatgaaacaaaacaaaaatactgaaattcatcctttgatatccaaactgattccatactcctaatagaatgaaggcatatgggagccagatagtaagtagagttttggctggcatttggctcacggtgtaatcactgggtccacagaccaaccagatggtgttttccaagatcttccaaggtattactggattatacatccttggtagttggcagatcccccacactggttttttgttctatatgtaacagccatcaactgtcgcttcacccacaactttattcatttttcatcatttttttttttagacaaggtttcactctgtctcccaggttggagtacaatgacatgttcatggcccactgcagcctccacctccctgggctcaggtgatcctcccacctcagtctcctgaatagctgggatgaccggtgcatgccaccatgcctggcgaacttcttttgtgttttttgtagagacagagttttgccacattgcccaggctggtttcaaactcccgggctcaagtgatgtgcccaccttggccttctaaagttgtagaattaaagtcatgagcctccatgcctggtcatttttttaatctttattgattttcctaacatttatattgtcagaaacaattttttacaatgtttccgtatttttggtgtaatatcaaaatacttctatagtaaatcatttgggttaagccattttcttcttaaagaaggcgggggaggtggtctctggaatattcctatttatgacactagtctagcaactataaaaatatggatagataatggtatatgacagtggataactgtaaacttatccagacagtaacaccaattgctgttgctgcaccagctatgttattttttttttctgaagcagattaacacagccttcagtgtgagatataaagccatcaaaatgaaaatgcatttatttccagccatttcaaaaagaaaaatcagaatcagtttagatccacatggaacaaaaagaatacacttatagagttttaacttgagttctgttaactctcttgacccctattataatgcagtatagagacctgaaacattgacacagtatgtggaacgccacactggtccattatatcagcagttctgcaaatgtggtctttgaatcttgaaggtccctgaaacactttcaagagattaatgaggtcaaaattatttttatacgcattgtgttaacatttgcactgatgaagcaaaacaatgttgtataaaattgctggatctttagcatgaaacaagtagcacctaactatacttgttattaatgccttgttcgttgctatgaattacagtttttaaacaaagctttaaaatgtccttgatgaagcagtaaaaattttattaaatatttactcttgagtacaattttttagtattgtttgtggtgaaatggggaatatgcataaagcaattgtgctgcataacaaactgtgatacttgtttaaagaaaaacacttgtgtgattgagaacaaaatcagccactttgttcatggaacaccttcaaaggtactgatggtaaaattatggttattcagacttgggtatcttggggtagttggcagatattttcttaaaaatggaaggagtttttcagtttgatggaaaacaactgacagtatttgttcccaatgataaaattcaatgttccaagtgaaaattaggaatttagaaactttttgtatttactagtcttagcttgaaatcaacaagtatgatttttgatattgtataataatctgtgtcaatatttgaaagcctgcataacagaactgatattattttcaaatgattaattcatggtattaaaaatcactcatagttaagaaatccattcaaagttcaagacatacctgtagattttaatgcaaaagagtacaaaaaattgattgatgtttctatatttcacattgcaagtaacctttaagaaactactacttgttgaattttgatataatgccaaagaataatatccaaaagtatttgaacagattattaacatatcactctttttcccaactacatatctgtgtgaggcttgattttcttcatagacttcaattaaaacaacatattgcggggaggagccaagatggccgaataggaacagctccggtctacagctcccagcctgagcgacgcagaagacgggtgatttctgcaattccatctgaggtaccgggttcatctcactagggagcgccagacagtgggcgcaggtcagtgggtgtgcgcacagtgcgcgagccgaagcagggcgaggcattgcctcactcgggaagcgcaaggggtcagggagttccctttcctaatcaaagaaaggggtgacggacggcacctggaaaatcgggaaaatcgggtcactcccacccgaatactgcgcttttccgacgggcttaaaaaacagcgcaccacgagattatatccgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagcctggaagctccaactgggtggagcccaccacagctcaaggaggcctgcctgcctctgtaggctccacctctgggggcagggcacagacaaacaaaaagacagcagtaacctctgcagacttaaatgcccctgtctgacagctttgaagagagcagtggttctcccagtgcgcagccagagatctgagaacgggcagactgcctcctcaagtgggtccctcacccctgacccccgagcagtttaactgcgaggcaccctccagcaggggcacactgacacctcacactgcagggtactccaacagacctgcagctgagggtcctgtctgttagaaggaaaactaacaaacagaaaggacatccacaccaaaaactcatctgtacatcaccatcatcaaagaccaaaagtagataaaaccacaaagatggggaaaaaacagaacagaaaaactggaaactctaaaaatcagagcgcctctcctcctccaaaggaacgcagctcctcaccagcaacggaacaaagctggacagagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaaggctcaggagccgatgtgatcaactggaagaaagggtatcagcaatggaagatgaaatgaatgaaatgaagggagaaggaaagtttagagaaaaaagaataaaaagaaatgagcaaagcctccaagaactacgggactatgtgaaaagaccaaatctacgtctgactggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagatgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatgcagccaaactaagcttcaaaagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccgtcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctaccaagcaaatggaaaacaaaaaaaggcaggggttgcaatcctagtctctgataaaacagacttgaaaccaacaaagatcaaaagacacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgggacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatttcactcaaaaccgctcaactacatggaaactgaacaacctgctcctgaatgactgttgggtacataacgaaatgaaggcagaaataaagatgttctttgaaaccaacgagaacaaagacacaacataccagaatctctgggatgcattcaaagcagtgtgtagagggaaatttatagcactaaatacccacaagagaaagcaggaaagatccaaaactgacaccctaacatcacaattaaaagaactagaaaagcaagagcaaacacattccaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaattggtaccattccttctgaaactattccaatcaatagaaaaagagggaatcctccctaactcatttgatgaggccagcatcattctgatatcaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatggaaggcaggttcaatatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaggggtattcaattaggaaaagaggaagtcaaattgtccccgtttgcagacgacatgattgtatatctagaaaaccccactgtctcagcccaaaatctccttaagctgataagcaacttcagcaaagtctcaggatacaaaatcaatgtgcaaaaatcacaagcattcctatacaccaaccacagacaaacagagagccaaatcatgagtgaactcccattcacaattgcttcaaagagaataaaagacctaggaatccaacttacaagggatgtgaaggacctcttcaaggacaactacaaaccactgctcaaggaaataaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctatagaatgggagaaaattttcgcaacctactcatctgacaaagggctaatatccagaatttacaatgaactcaaacaaatttacaagaaaaaaacaaacaaccccatcgaaaagtgggcgaaggacatcaacagacacttctcaaaagaagacatttatgcagccaaaagacacatgaaaaaatgctcaccatcactggccatcagagaaatgctaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagtcagtgtggcgattcctcagggatctagaactagaaataccatttgacccagccatcccattactgggtatatacccaaaggactataaatcatgctgctaataaagcacatgcacacgtatgtttattgcggcattattcacaatagcaaagacttggaaccaacccaaatgtcccacaatgatagactggattaagaaaatgtggcacatatacaccatggaatactatgcagccataaaaaatgatgcgttcatgtcctttgtagggacttggatgaaattggaaaccatcattctcagtaaactgtcgcaagaacaaaaaaccaaacactgcatatgctcactcataggtgggaattgaacaatgagatcacatggacacaggaaggggaacatcacactctggggactgttgtggggtgaggggaggggggagggatagcattaggagatatacctaatgctagatgacgagttagtgggtgcagcacaccagcgtggcacatgtatacgtatgtaactaacctgcacaatgtgcacatgtaccctaaaacttaaagtataataataaaaaaaaatattgcaataaatggaatgtagaagcagatatgagaatccagctgtcttctattagaccagacattacagagatttataaaaagcaatacagtgccactcttcttactaaatttttgttttttaaatatagttatttaaaaatatatttatagtaacatgtaataggtttattaagacttttaaatgaatacatattttaataatttctcagccttaatgttttatatggtaacaatagatgtacctcacataagcaaaagttctttaggattttcaataatttttaagagtatgaagggatcctgagactaaaagtttgagaaccagtgtactctttggctaattgggctagatgagcaataaatgatatgtaggctgtagatcttataagataatgacttgccagggtgtgaaagataaatcctctaaagagtcaattcatctttgtattatgcatccagtggtctatagtatgtcaggacatgttctccaaaataaaagataaagtattgtattttatacttacagcactaagaaaaagtgcaatgttggtaccttgtccccattcctataagttcatccacaagcatcttctttggaacactttgttaagatctacaggtccatttgtattctcaccttgggctactctctatacaaaggataactgggcaggctcccagagctctgctcattgggaatttctcctttccactaccccaaaagcagcactgctggaatagcagcccttttttagaagcacactaacaaagcaagataaactattcaagaactctcattaaagcttttccttctctgacatttggtcctaagagtcataggtgggagctgagggggaggcgggggtccagcagtggtgggaacaacagacactcatgcagctttcctcgctctctggccctacatgtctgatccaggtgttctatctacttctatcttacaatgaattctgagcttatgacttggttggtctaacaaaactcagcatatggtgggccctgtgatttcattatggtcacttgctatggtcagatgatccatatttatagagtccaagtagcacgtccagagcttgttctcagttgacatatagttttctgctgccaatgccatagccttgctccacagccttagactacattgtgattctcttattgaagtgtgtcatcaactccacaaagcatcttttccacatatatatatgtaccgcatatgcggtacatatatgtactatatagtacatatatatatgtgtacatatatagtacatatatatagtacatatatgtggtacatatatatatatagtcctgtagggtctgtcctataacttaagttacagggctgcttgcatttcagattgacctataatagaatcattttatggtctgcatctgacacaaagctataagcctctgttattagataaagtagttagagccatactcacaagtgcaggtcatactgcctaccaactttgccctttctgtttgcataaccttattaaataaacctaatgatgacatgataggaaaaataattcatgaccattctcatgaacatagatgcaaaattttaaatgtaatattaataaataaaatccagtgttgtataacaagataatacaacattccaagttagatttatttaaggaatacacggttgctttaaaatttaaaaattcagcagccaggaaaggtggctcatgccagtaatcacagcactttgggaggatgaggcgggcggatgacttgagcccaggagtttgagaccattctggaaaacatggcaaatccctgtccctacaaaaaatacaaaacttagccagacatgatggcacatgccagtggtcccagccgcttgggaagctgaggtgggagaatctcttgagcccaggaggcagaggctgcagtaagccagtatcacatcactgcacttcagcctgggcaacagagtgataccctgtctcagaaaaaaaattaagcaatgtaattctccacattcacaggataaagaataaaaagtatgattctctcaatagatgaaaaacaataattttataaaaatcaacatgtatttataacaaaacatagtaaatttgaaataaagaagaaatctttaacctgaaaaggtgtatccataaaagtatacaaggaacattagagaaatggtgaactattgaaatctcccccacagcctccaatatcaagaacaagacaccaacgtccattttcaccccatgtattcagccttgcactggagactttaaacagagaaataagaaaaaaaaaaaaaaaagaaaaggattaagggtaaaaaaagaaggaatgaaccatcatcatttattgatggcatgatatttatttaaagtccaacagtctatagatacagtattagaattgataagtgattttagaaagctgtgtattttggtacaacaaaaacaattagagagtaaaagttagaaaatatattttttagaatagcactgttaaacaccaaatatctaggcataagacagctacatagaaagttataaaccattataagaaactaaaatgaaaaaaatggaaagctataccatgttcaccatttagaagactcagactgtaaaaatgccaattgtccctaaactgatcaatgtaattttattcaaaatccctgtggtatttatttatttatttattttagaggggagacattaacaaactgattaacaaaacattaattaggaaactgtagtactggcgtaaggactgatgaatcgacccatagggtagaacaggtgtcagcaaactgtggctttgtgccagatctggcctgctgcctgtttttgttggagcagagccatgcccatttatttaggtattgtttttggctgtttctgtggtacagtggcagggatgagtaggtatgacagagagtatatgacccaaagcttaaaatatctactatctgacactacagaaaaagccttctgacccctactgtggaatacagtgttcagaaataaataaactcataaacagaaacttgggattaagattatgttaccactgagtagtgggtgtaggagtcttttcaataaatactgctgggtcagttggataatgatatgaaaaaagaaattattcttgatctaaatttaaaccatgcacaaaaatcaattccatcttaatgttaaagttaagccaataaagcttctcaaaaataatatagcagatgttcaaaattatttttaaaaactacagataaaaagcaataagaaaaaagtaataaatggatacattggactttaataaaattaagacattctgatgtttaagactttgtaaactataggcaaggcacacagtgaaagaatatatttgcaacccatagagaacaaaagattctagttccttcaaatataaattatatataataccagttaaaaaataggcaaaagacttgggcagatatttcacaaaagaaaatgtccaaatgatctggtcacataaaatgatgtttcacatcattagtcatcattaaaatgcatatttacagaacaataaattaggatgcctaaattaaaaagactcatcattcaaagtgttggagaagatgtagagcagtgatagcccttgtgcactgctgatcatagcgcaaatcagtacaatcacttttagtagcgtctactatagctgaacatgcacataccttatgacccagcaatttttattactcaatttatacccagaaaaatatataatcttcaatgataatgttcatagaagtacaattagtaatagcttcccactggaaaaagctgcgtactcataaaattaatactataaaataatgaaaatatggaatttaaaaggccagatgcaaatcaatatatgccatataattctactataaaatataaaaaccagaaacatttattcatggtgaaaaaggtcagcatattgagtagggcaagtgaactaggggtttctgtggtgttggccgtgttctatttattgatcagagagagtggttacataggtgtattgactatcaaaattcattgacggtacatataagacatgtacacttttctgcacatatgttgtagtttatgacagcgttcagtttcattaaaaggataacacatagagagggagtagggaatcggaggagatggggtgatattttagacagggaatcagagaaagcttctcttaagagagcatattttaacaatgacctgttttcagtgacctgaaagaagcaagtgagaagccatgcgaagccatggaaagtcatattaagatctgagataagaatattccaggcagagagaatatcaatgcaaaggctttgagatgatgtcatgcttgatgtgtttgatgagtatccgaaagcctacttgggcttgagtagagtgagaagagttgtcataaattagattggctgacacatattaaactattgagtgaatgacttatatgaagattcacatttctggtcttggcatgattatttcttgttatctgtccattaaatatacatgaaacattgtaaaatggttttcaaaaaacctgtctattagccttagaaaacaacagatttaataccagggtaatcactttacttagttcaagaactgaattccatttcactaaattttcaaagtctagagaaaatgttttgtccatcctacacaattcctaatgaaggaaaaagacagaaaccagcagttaatcaagacattagttaagttgagggaaaaatatgttgataaaagcataatctcttcatttactgatcatttatgggaaaagagctatacgcaaattttatatatgcatatgaaagttttggcgggcacagtggctcatgcctgtaatcccagcactttgggaggtcaaggccgacagatcacttgaggtcaggagtttaagaccagtctggccaacatggtgaaattgtctctactaaaaatacaaaaattagctaggcatggtggcatgcgcctataatcctggctacttgggaggctgaggcaggagaattgcttgaccccaggaggcagagtttgtactgagccaagattgcaccaccgcactccagcctgggtgacagagtgagactctgtctcaaaaaaaaaaaaaaaagaaagaatgtcagatttaagacccgacaccagcagcaatggaaaccgaacaatagaaaatcattctttcaaggacttatttctcttaaagatataattacctaggattgtccatgaagaatgagcaatgtcatttgcggtgatggaagctcattaccaggtggcaaaaaaacaataattatactttctacattttataagaacctagacatactacattttaaccctgtgatgttttcctttttaatttaaaaatagcagcatcagcaatcaccaccaagaataaaacaataacacacgcgagaacaagatacatattcaaagtcctgagacctcacagtttccctgagagttgcaagtgtcctgcaatgagacaatggacgcttctgcctagaaagagttgctgcagaagcaggagacactaaactttaaacaaaatcatagaactctttcaacctttcttctcgtattgagtctacgttaaagtgccataaatcttgttgacagttactgccacatctattggcacacagtcagcatctgtttgaaaagagttttgcagcataggtagggcccattacctgttctctgtcttctcttagtatttattttcaccccagcaggcagcacctcacaatgtcattaatttcttagtcagcctgtactttcccttacagccacttagagagtgctcttataaacagctctgtgcatcaccagaaatgcattgcacctctagaaggaaatcagaaatttaagagcagcaggtacaacgtgaactggttgctgaggtgatgtggtctctgttgctagatcagtggggggtcatcatggtgatttggttatatggttccgagggaatcagtgctgttggccaacacaatcttaagaaagtgagcgatggtagatgtgcaactgaagggaaagcagcaagaaaatacgatattccacgattcaccatgaagaagaaagcaacaaatgagtagacaagacagcaagaaattacctgcataaagaaggcattctaatcatcccaatacctgaaaagagtgaactgtactctagtcaactttcgttgggataaatattctaataggaattgcccctttcttcagaaaggatgattaaaaaacatcatcaatcaaagctggaccagaaaagcaatcagaacctaattcttcattagaacaggtttaaagatgtccagtcatgaggactctactactttaatcataatatggtttttttacaaaaattaaaaatttccataaactaaaatatggatcacatttatttttattcttctgtggggccaggactcatttctagaagggctactggtccacggttagaaaatggccccttcacctctgtggtaaatgtgggctatatgtttggatgtgcttcaaatattctagatgggtagctttgtgcatattttaaattttatagaaaaataatacaatcttacatttctatttaatcattgtttaaaatgtattgagctgtaaaaatcacacaaggaggtagaaaagtcagaaatgtttatgtctacttatataggttatgagacagacctggcaaagataattaggtcacagatttcttttttttttttttttaaccatacaacttattgtattcatgtgcttatagtctaggaaactaaaaactaaaacctgtgtgtaagaaactcagtagccttcaatgtctatgtcaaaagtctcccctattagcagctgctaagtggaaaagaaagctgaaggaaagcagcctgggtaagttgagaattctaataaaccaattggtatgatactaatttgctctttttttttccttgcccatggaatatgataactcatttttatcatgcacctttgggaagattgaaaaccaaaaaaatgaaagaaaagtcagtacagtattagaactaatgtcttcccacccaagctactgtgttctggtgcatgagtcaggtggagcggtgctacaaggtcaaccaagagagtgggttgttcaactactgtggcaggaatcaccatagaatggacattctcacctggaggaggacttgtaatgaaatctgaagaaaacattattctcaagagataatatgtagtggaaggaaagaaaattaagacagagaagaaggaattcccttctcctgtctatacattttcaacctcctttcctttgcgggaatggcataatgatttgtttcttagagaaccttgttttgttgtttcctatcagcttcctctgcaaaacaaaaacacccctgaacccgccttcctcttgaagtaatactttggttccctgattttctgattagggctttcaaaataatttgtgttcaagtatgtttttattccaggcttcattttgatatctacatgtccattattagcctgtccccattaaccaattaagtacacatgcaaacacacacatgcacacacacatacactctctattacaacacatatacacaagacatatctgagtactcactagtaaatactcatgtgtactaaagtctaccacaggggtttcaaatgtcagttgtgttttttagtttaattcaacttttatacctatagtaattcatttatttcatttttgattattttaaatgttttggataacagaatggctcttgaattgcaacggaagttaaatttcagtatctaccataaacagcacattcatttcattcctcaagaatgaaaacacctgttatagttcctttttgattgctgacttttaaatgaacatttggatgaaaagtaatgtttacaaagataacatatataaaatattcagaagacaaacagcagaaatgagaaacaaaaaaaagcaaacagaaatttaaaatagtttgtcttaacaaaacaattacaataaagaatttattaaaaacctttggaagaaactgtttccagtaatttaaaaataaacagaaaatatattaacaaataattgaaaataatatctaactgcacaaatgtataaaatatctaactcaaaatagcactgttaatatgtcagtatattttagttaacatacttttaaaatgagacacacagattacttcattgcatatctctgagagctcctcaaatcctacacacattttaaattgttaaatttgatacaattactgtctttttaaaatcaaaagagcattttcctacttttagactgagtaaaagatgcattgactccttgcttcccactagactcactagacattctgatactgcactcgtggtgagctggccagagtgaggttgtgaaaaaaagacaacaataccgaggacatttgggcaaaaaagtatttatcaccaagtataaaaatttttgtaaagccatcactgattaatacattatttcatttttgctcaattacttactagagaaatgtataagtagcattttcagttccttgcaagagaccatggttagcttatttcatggcaaaaacatgttaaaatatgaaatgacttctcaaacctattttatatggaagtcacatttttgtgcacatgactttttaattttgaaaagacgttttatcacaaattccatgaaactttctttcagtaaatctaaaaatggaatgttctatgatactagttgactttccatctcttactattcttctaacaggatactctgaaaatttgaatatcatagacttagtaagaaaatatgttttatgtagctttttgggttaagaagcattagtaggaaaacaagtcagtgtgctaagggctttaattatccgaagagacatacatttatatattcggtaaaataaaattatttaatgttcttcgttattcaatatttttgaaaatattgttatgtttgtgttttattcacagaaattcagttttacaaatagcagctgattttttattaaaccagagccaaattactaatttcagtattaatagttagctttgacatgtttaaaaagggtagaaagtacgtaatagacctgtcttcaactctgaaatgaacagctgctcagggaaatggaattgttcaaagatacattttctttctgccaatctgtgaaatataatataattattctcttttaatgaatctctcaacgaggagcaatctttcagagcttgagcaggtaaaatataatgataatgggaacagctttgtaaataaaaggatgaaatgagattgttattttgtgccatattatgggataattaaaataacagtgcagcattcagcaggtatttgaactttctaaaaaatgctccccagggctcttttaaattagtcatgtttatccatgtagatttgtaatcttactgcaaatgtctgtcaccttataatattcagacctcaatacttaatctgattaatatctgatactgtacaacagctaacaaaccttgccgaaagcagacattaaaataataacctgagttgacaaactcgaatttattaaaagaagaacaatagaactattttcattaagccaggagaatgattactctcagtgtggtgggactcatgaactacatgagattctatgtatttccacaaaacagagtggccgcacacttccaaggagctactattcacatgataattagctctatataataaaagagtatattcatggaaactaaactcatggcaatggaactccaatggctagttgctttgtttaattcaaattcatacagctcaaatacaagtagatgatgagatctgatttttcaagaaacaagttcctttgcagttcactggaccctcctagcacccttcttagaaaaagtgtgcaagcagaatcaagtgctagagtgtggccattatatcacatccattaaagttattagaaaacaaaatataaataaagaaggtaaaataaaagtctgatatctcttctggtataactttaaattgctagtgagatatcatttcacgaaatggtacaattgaagttttattctcaattaggttgtagtttttctcagttattattctctatctggaggaacaaggaaaatggtttttaatatcaataaataagtaactgtgacttctgtttcatactttctgtagctgatttcatgtctttttaatagttctttcatgcttataattttttaaaatcctccccaactgattgtcagatatcctgatgatagaaagaaattattgtaatttcctggggagctatctaccaccttagcttcaaatcattaccctcaaagggcaagatcgctatcaggctttatatttaggaaatttgtatggatagcctcatatctggaaactttatgtgtctactattagaaggtatactctacatgtgttatttaatcacttgagcgttatattatcaggcaatatttatttagtttggaaatctgttttatatgtctaccactgggtacgttaaattgacttaaagttaagatgcagctttactctaggtaggtgatctgccactattttcaatagacagaggactggacaactgtgccacagaaacaaataagatgataattttaccactgatatcagatatcaaggtctacagaacatacccattaaagcatttgtattttctaatcttctctgcaattgcaaaaatcaatagctagaaatatagaagggttttagaatagcatgtagaattttgaaaataaacaatgtattcttcctcagaagtcatataagattaacaatctgagccttaattaaaaatcctgagtaaacacattcatttcctttttcccttgcaactattaaattgatcaataaaccatatatttttcaaaatgcgactggtactaaaaactcatttttcttgtttccctacattcattaggtgatagagagttgctcattattctgccatccctgtgtacctttttggattttgcccattttcctaatttcaatttcttttcaggaatgaacaaattgatgatcaatggtgatgatttcatttatatattagaaaataccacttttctgtttaaatgattacttacctgttatattcaatttaaaatggctttgcagtcttaccaattctaccataaaaagttatagcattatacttcttgtcagattttgtttttaaaattatactgcacaccagattttttaaattttactgttgaacaaggggaaaggtggcaataatgatggtcatgaaaaggtaatttgtataccttcagaagacatatgagaatattctaaatattgtcatctagtggctcagttcctccaaaatattattcatatttctagtttgtgctttttaaatttctaggagctaccagtgtctgcagtttctacagtactatgacaaatagaaatttcattaatgcttctcgataatgcatgtgcttttataggatagccaaacaaaggataagagtacctggtcttatatattgaaaatttttttatttttacattttagaaatatgccttatattctctaactttttattactttttacaaacttcaaaattataacttaaaaaaaatcttagtgccatcacattaagatacccaggtatatgatgtaatcttaaatttaacagcaattttgatatttagtcttattaagcatatgctattatttgcattaccattgctaaaaaatttcaaaggaggcagtttaaaaacatagttgggagacatctacttaaaggttactagatagcaaatgtttggatctatctattttcaaccaatgaaaatatcatggtattagtgtatgcatatatttttgtgaaatgcaacatctcaaacgccatactatttttcaacagttttaacaaccaggtgtaataatgctgcatgaaatccttttcttgtttccaaatttaattgatttaatcactgaaattaaatgcttggaaattcttctgcttgccggtgtttgaacgccaaatacatcatctacagttctaaaatgaatattgcatttatatttagacaacttaaaacactgctttctaaattaccctaaataacccatagaaatgtctagaaaaattcataatagtggatgacaaatgtccattgccatcaaccttcaaataagaataacttttacaaggtatacaaagtgtacaattatctgggaaatataatgtaaagcacacatagattaatcttacttcttccagcactcaccaccagtgagctcttccaaaactcatctttaaagatgaagacatgggagctagaaatcatatttatcttcagaggcaaaagaaatttaagttttgccaagctttcacagacgtcagctcatttattctctttgatcaatttggtttgtattgctttgttttgcttttcttcataatttctgggagttaaaaaattaatagtaataaagtcacttgagtagagatactccttgacagccaatcagatacacagtctctcccaacagtgcatagagagatcaaatagggtgagatgaggatatgtttggtgcaaagtatatggaaaagcttattctgggggaaataatacatagtaaattttatccaagatgatgaagaataaaaacaatgtttacagtaaagtatttccacatggggctacttatctgagtttgtttgtttgttttttgtttttttggcctgaatttttccatgaaagatagtagctagcattaactaggcatttgctacgtactggcccctattctaagcttctaatctgggcttttctcattctcacagtcaccatatgaggaaggcgccattctttgtgcccattttagagataaggagattaaagtacaaggacatgaagttacttgcccaaagttgtccagataagcagcagagttggggtttgagccagctggaatctggtgcctgcaccaagaaccacgaacactatgccgccttcgtggaatgtgtaggagtgattaagcttaagtatttccacatggggctatgcaaacactatcaaggtggtgaaaactgcagcagctgagtgtagttttctaaactttagtctttctggcttcaccttcacaattttggcaacatctaagtatcttctaaattatcacttaggtaggatgttttactctatttttacttgaattaatttttaaaagaaaattttgattaacattataaatgatagtaaaaaattcagcatttcttaccacaaagagaagacaactgtaatagtaaatataaaaccattaaacttttaaaacattcatccatgtacccactaacccatctcattttccatcagtggagtccttgctgggttttgggaaattctgcccgaagaaaagagtatcattgttaaatgtgaatgaaatcactgaaaactgtctggacaatataatatgttaattagtttttaaataaacttttgcatgatgggtacctggacagttgtatccatatgcagggtagacagtcacctattaatgaggtttcaagcagaaagtccagctgctcccttagcttctggcaaatgtttgaaactccataatttgaatataattactttcgctcagtggttatcaaactttttaaagcagtcaacaacttcattttaaacaaagcaacattttataaaccagtaagtaaaagagaaaattgaaattttatttgtgcaaatccattttagaagttctaattgctaacactctcaacacaatcaatcagtgagaggccgggggcagtggctcacacctgtaatctcagcactttgggaggccgaggatggtgaatgatgcggtcaggagatagagaccatcctggctaacacggtgaaatacccctctactaaaaatacaaaaacaaaattagccggacatggtggcgggtgcctgcagtcccagctactctggaggctgaggcaggagaatggcgtgaacccgggaggtggagcttgcagtgagccgagatcccaccactgcaatccagcctgggcaacagagtgagactccgtcttaaaaaaaaaaaaaaaaaaaaaatcaatctgtgagaataatggatctattttgaggaagacaattgcaatgcgatagtatcttatttttcatagatttctgcattttgttttggttttgtggtattggcaatatcctgatacagacatatatatataatcaaatagtatgaatgtgttgcttctcagccatgttgaaccattctgtctccactaccaaaaactggaatagacttggatcttcaaagctaaatcaattagagtaactaaaatggttcatattccttgagaggtcctcactcttggttaaaaaatacctttcaaaagtgtctttttaacagaatttttcactttcaacaaaacaaattcatgacataatgatacttgctgtatcattgaattgaattgaattgcaaagcttcaattagtcaaatatattttattctgtgtacatacctgaaaagctccaatttcattgctggctgcttacacgcagttgtgagcatgtttaaaatcttctctgataaaagtgtgcttgatatataagccagtacaaaattattattaatatttgggggagttaattaactgatacaatttctttatgaggaaaaatacatcttatggtggtctgcattttcatttaggtatcatcactttgttttcatgtccactgattgccatatgttgtttggtgcttgtgccatgcaaaagtacctgaatttgctggccttttaattgcatgtggttcccatgcactgtggtggtatttgcacaatattgtggcccatttgcacaatatttctcatgagatatgcaaagacatatttttaaatgtccattgcagatctatagactttccagtcaatgccacagttatttatttctttatatgtatatacatatgtgtgtgtgtgtgtgtgtgtgtgtgtgtgtgtgcgcgcgcgtgtatgtgggtatgtataactatctatatatgcatctacctatatagaaagaaaaaagaggaggaagagaaggaggagaagttgtttttgtctggtaacacaagttaatgatttgagaactgttaatatgacaaatatatttttattatagtttttttattgtccgcaaatctggcaatgaattttttttttttacatttattacagaactgcagaggaattgcagttataactcaatggaacacagtttgaaaaataacattttagctgaaggtctttatatcttttaaaatgcaaaaacctctactttcatctgcaatcagtcatttgtacattaatgtgaatgaatttattagacatctttctgagtttaattcagaagagggggaggaaaagatgaactcagctactgaaagacatgggaaaggtcgaatattaacgctaggagaactgaagactaatttggcctagtttacagttttgcttcaagactatgccatctatatataatacatttatttgtatttataaacacatatgcacacaaagaaaatgtctactgcattagttgagtgtgagtgtgattatgtttcagaattgcatccaactattttagaatattttgctggaataatgtaattacatgaattactcacaattttgtcaactctaaagtaagtcaacagtaaaatttccaaccaatgaacttattgaagatattctgattttattatgtgagtgtcttcaaagattgcaagcaaataaattatgcagaagtcccagattatgtacagcttaatataaataaggacttaatgctccaaacctgatctcatacctttggactatgatatttctttaaattaaaataaaagagtaaactttaaattaaaataaaagggtaaacttaaaacaaattaaatccttttattaaataaaataattacctttattacatgaatttagttacatgtgtcccccattttctccccctccaaaagaaactatctaaagtttatgaaagcaagtatctatttcaacagtgtaaaaatttagttgaaacttctgataattttttacagaggcatatgagaaacagtgttagttaatattttaagaaagaacaagaagaaaattacgttaagtttttcatttcatttcatgtattttctaacagtgaaagttattaatttgactgtaggttaaaaacgtgttggactagagccatattggccatattcattctaaagtcagtgcttataatgattttgtgtgaatttgaaatatatataaatttgaaatactcacatttaatactattgctgctttgttgtgtttttgttttgttttgttttgttttttttaagagacagagtccttgctccattgtccaggctgaggtgcagtggcgcaatcatagctcactgtagtcttgaactcctgaggtcaagggattgtccctcctcagccttctgagtagttgggactgtaggcctgtgccacccaccaggtgctattcccacttcctcctttcccagtatgttgcctaggctgggcttgaactccctgcttcaagtgatcctcctgccttggcctcccaaagtgtgaggattgcatgtgtgagccaccatgcctgccctattgctgtttttatgtcaagaaattgaaaacaaaatcaagtaatagaaatattactatttaggaaagggataaatgtaactatctcagtagtaaattttgtttttggctattaagtataacattgaagaattagcagaataaatatgaaatcaaaacttagaagcattttgagatacttttggtattctgttgcaaagtatctcaaagtgaaaacaatagtgaaatcatcactaaaaagaaaagactaatatataacaggtttttaaaaaatattcagctcaaaaggtcattcttggttctgagattatatttatcctgaaataatactaaatcaaaactataagctagtcagttaagtcagggaacagaattgagcctaacatacttctgtttttgctcatagaatgacctttgaaacctctctgagctctgctgttttttaactatttcccatctgtgtacagagaaaaatgtattactaagtcacaaggcctatatattcccacttcctcatttcccagaatttatgggaaattggttctaatagttccacagtagaaagcaagaagacagaaaggaaagagagcgcttttccaacagttacaggcactgacagcctatgacaatatttgagtctggtttgtttgtagtttcttccaaatgtgtgttcctgaaaaaaaatcatacgaaggagggtgagtgagcccaggtaaatgacatgtatgcagcagctccagagcgagtgtacagacatgtgtttgggtggagcacagtgctgtatctaagagatgttcaacaacccagtgggtgaatgtagttggcagctgagccattgagaatcaatttgtataagtatcgggaatgtgtagatgcaaaagacatatcaagtattgagatgtagtgaccaaacagaaaacttaacctggaaattattttgtatatattatttagtgaaaatatttttaaggaaggaagcaaggagtacatacgtagtacctaataatacaggctatacaattacaaaagggttttttaagcttggttttagtatggtccttaagctaattgcaatacttagaatttttcactaccctttttagaaatctactaattttacatttaaatgaatatttaaatacaaatataaattaatttcaataacttctagaaactaataattatatttattttcctcctctaattcatatagcacgaacctcattttttctatatatttctccttcaaaatattattttcctccatattttcatacagttatattttgagtatgtaattttttaattgatttgttataaacatgcttgtactaatacaattctccaagattacttacacattttaagggcatcaaaaccacctgtcattggcaggttgtgataagcatttctttcaagagaatacctaacactttctccatcaatcttttccactttcatggtaccaaattttatataaaagaagtcactgcttgttactgaaacttgaaccaggtactcaaagacaccaaaacataaagctattgcccaccaccataaagcccaccaaccatcttctcactttattctatttcattttttagtaatttatttatattagtccattaacactgaaatctcttcatattttgtccttgctacactgagctgagacaacatgttttgatttctcaatgtcatcagtagtattaggtaaattctagaaggtaaaaatgatattatagaattacatacataaactattgggacatgattagttatcagaatatcacattgatatctctagtttataaaatctctaagaattaggtatcatgtcccaatgagaactatattacaatagagttgaaaattctgacccatagttagtctagtctactttttttaggtctttgctttctgtttcccaggtctcctacttgttgttactaactttctggaaaaattcagcagacaaccaaaatttatcatgggatatttaaacattctgttatatatggtacttagaacaacagctctgtaaaatagcttcaatctcatagcctgaccaaagcagaaaaagaacaaaatctcttataacacaaccttagaaaagccttaactacgtccttattccagcaactcaaatgtcctatttaagacaatcacgtttcagaagagcttaatatacaatatcttctattttattatccatgaaataccccaaatgtattttattttctgtgggaagagctatatacgaagaagaataacgaaaaatgtagccaatttatacttgagttagaatctattgtgatataagttaatcacacatgggtatcccataatatgaaaaatacaactgtaaaaatatataaattattatagtgcaacggaagactctttacttttaaagaagcctttgaaaacaggttaacaagcaatttaacaactaattgttagaaaactgaccttgacttgcaaacttcaactctttggcatctgtgacggtggtccttttgtcagacccttttttctctattcgtcgatggcttcgtcttttcttagactctccccaaagattggatcctccatgcatgcttggtatattcaaaatagcaattccttccagagagatgtttattaaatctatctgtactccatcacactgatcggtaaaaagaaagaaacagaaacggaatattttatctttatttccctgatttcttgtttttcatttcctcatcttttaataagtgcgttgaaatccataatgttgtcatttccaaacaagcctttcaagaacacttaaacacttaccctgagtcaatataaaagataaagcagcccctaacattaaccagttatctctagaagtccttaaaaatgatcaaattaaatcaccagtatatctttgtttgtagaaaacctttgggagagactcgttagcatctgcatatatatttaaccagctgcaaatttccaatgtgttacaaaaaggttaattctggaaactatggtcaaattttaggaagaaattgtgatgattgcccctgtttagaacacactgcaaggtactattgggggaaagtacagaaagcagattgatgcctcatggtctcacacctttggggcagagaaagaagtagcttaaaagacttttgctaaaaaaaaaaaaagtaaaattcaaagcagagattctaagagatttcaatcacactgaatttaccaagggtggtttcttggactagatgaagtcctaaggagatgtcaaaggccatgagaggcacagttgtccaaatgaatatggagggccgggtagattgattgagggaaatagtagcagtcaaaagaccttcaatccagcatgactttatagctgctgcaaaaatggttaaaaaaaaaccaaggttaatcagcccaatttttcttattttcctggtgacaaaacaccctggtgattatgaaaaatataaaattcactaacaaacaatgttttgttatattcagagtggtcacttcttagttttttgaattttccattcatttccactactggacatatgtggacagtgacaagactattctgtatttttaaaattactatttatttattcatttgccttgacttctttaaaatgctagttattattatacattctagaaattattatcccattttcaattataagtgaatatgaaaagagatataagcgctttgtttttaaaagaactttgtgagggatatgcatttcctaaattgaaatatatttacagtggcgttgtttcatttgccatgtcttagtacagaaaaaattattgacactaacttcatcatttctcatggcagtcatgatttttgaactcagaagacacagtgttccatgaaaatgatgaaaaacaaacaaaacaaaacaaaaaaaagccctctctttttccacattcgcctcatcatactgaagctaggattgcatcttgttcactgaaaaataaaaactgtgaaataaagaaacacatcttgagactacttggcaggggtagaaacaaattctagagaaagtgccaagttttcatttaatttgtttcaatgagggcgaaaccaagatctggatgatgcttttttttttttttttttttttccagaaagcagtgcttttttcctccttttctggtactaaattaagatgatttctttttactaaagaattctggtcatgtgtatactcacttaccgctatatattctagataaacagatattaatttcataattaaaagtaatcttgtgtaaataccctgcaggcctcaatgaatcaaacacatactgtgtgtcaggcctcccactgtcttcaagtggaatgtactggctggataattagatagtacatattttttaaccttatttgcatgcatattatatcttttgcacactgacaagcagcagtaacaacaaaagtcagattaccacagggaattcccacaaagaagtcttcattccttataatttgcagcctaaattaaaataatttgatctttgacaaggatgaaatgtcaagcagaagggggtcctctacaagccacggcctgtggcttctgaaatctgcctaatttatgtcagtcacttcttaatacatatttaagtattacacgaaaaagatgataaatatgcaatctgacacctttggtatttccctgctgttaatttataaaggtctggcttcccccaaactgactaaaatcatttaaataacagaagaatcatgaaataagctggagtcagggcctggcttccattttcactcaatattgaacacagcaggtagtacactaagacaattatttgactaggccttagaaccccactgtgacaagttactttcagaattagtgaaggaggattcctttgttcatctgcagaaaaggagagcatgttgcaaagaggcttcttttttttttaaaaaaaagaattgaaccagctgagttacatgtgacaattgaaaaacatgagtgtatgctattattcatgttttcactcttcagagttttgtcatgtgtagttttagggaaacagagtaagtagctctctgagaagtgaaaaaaaattctcaaacagtcgcaaagaacaaggactgatgaagaacattgatgttcctttgagagcaggacaatgtacttaaataaattgctatttattaatgatttgtttccacttgttcttgaccctaggctaccttcctctgtttgctttaacgttatgttcattagtctggaaaatttcagtgctggttctgatggagaccagtaattgtagcacaccagttgagtgcatgaaagtaaaagctgaggtgaaggctatgaaatataaacaagttatagtactgtgtcagataatattttcattccctttgagatttatgacttttaaaaaggtagctacagaggaaaagaatataaaagcttaaaagctaacagcctcagttagtcaataaatcctgaatatttttattaggtagaaaaaaggtcgttaacatatagtactatgggagctatttatagagtgcaaggctgtgatgccattgtctgctcttttcagttttaaaatagaggatcttattccagagacaaatataattaaaagaaaagaagacggtttcaatttttctgccaatgtgttttaaccttcataaataaatgagtcctgggtcacaccgtacagaggtgttaaaaacaagctttatatgtgactttagtgtttcagatccacttaacatgtcagttgataggactattcaaaacatgtgaagaactttggagagctctaagtgtggatggtaaatgtgatgagatacaattaatgataaactgtaatttttttccatagtaggtctgattctatgtctatatcagataagaattatttctatttttactcaatgaaacgtaaaacattactttataggtaatttcagtattaggacacatggggcagagactatgcttgggaactctggctattgcctctaagaactctgttttccaggttactgagcaataagaatattgtcttttgaatcctgctaatttattttgtgtttttgatgctagtcatgccattcattaattcttgagatcatttaggtttctaggggtatttaatcattacaataaatcagtactttgggatggaaattcttggctttaaaatttaccatctttcccagtatccctgtcaaccaaaagactgaaatatctatagaataggctttcttattctctcattaactttgcctggtactctgagcaaactgaacattcatgaactctgtatcttcaattccaaatgctgacctgagtttcttaggcacacatttcacccctccaaatactttaatataaacattggttttaaaatattttcttgtaattttaaagaatttatttttatcttttgtaataaagttagaagataaatgaatatctttaaaaaattctacttcgtgtatcattaaatctttacatgtatgtgtaaatacatatatttttcaatcaatttgctcattagatttaaacattgtggcagcaacataattcttatttctcttaaattactgaagaaaatgtttatctctgcaatggagatataacagtatcataaggttttgataaagactaaatcaaataatatatgtgcattgtttagcatcacctgtgagacagttaataataggtaaatcttaactattattccatgatattcatatcaacccaaatatttgccctcttttgaaggtgctcactatgtgaaagagaaatattaaataaaaagacacacaaaagatagtttgattttgaaaaagctgccaataaaacatgtatctattgctggaggttctgtttttactgaagtagtttattctgttatatatttttcaaaccatagtaggtataattttaggacaaataggaagcaacaacaaacagaatcaaattttcgaatttctgtttttgttatatttaattataaaataaccttgagggtagaaaggcatattctgctaatatgatagacaggattcattaaaaagtgagcagagaagcagattttgcctagctatccacacacacacacacacacacacacacacacacacacacacaacaagatatgcaaaaatacaagggggcatgcacacagtgctggctgtgatttataaatattattttaatagctcccaaaataagccagggatgcagagctagaaggtcaggctgagagagtaagcagaaacagcactccaagaaacataacttagttctagtagcccagatttcttggagaacattctaaatagtttttctgtcagatctcaagctctgtggatcaaaaccacttaattttatcattatttagcatattacaaatcaccgttttcaaatatattttcattcaaaatcttttgctgtaaacacaacacttttcttaaagattttttttttgtactttgtgacacatagaatcttattttatagatcaacagcttttaaatctgtgctcaagggtaggataaagtaaagggaggtgcaggaggattcaggatctccacctacattcaaccaaagccatacttctaatttttctaaaacttttcagcttctgctgcaaattgtatttgagcataatttttgaggataagaaatattcaaaatctagtatataaagcagtttttttaaaaaaataatgattctaagagtaaaggggtatgtatatgttttattgaatatatatgcacataaatatgtatatgtatataacaatacatatgacacatatataaccatatatactatatatttaactatatatgtagttatatatgtcatatattattatatataatatatataactaaatatataactaaatgtagttacagatgtcatatattattatatacaataatatataactaaatatataactgtagtacatatacaattattatatagatatacatgcatatagttatatatgtgttatatatatcattttatatacagttatttgtgtgcatatatcatacatatacacagatatatcatcctaaatagtaataacagaaagtccacgttgaacccaaatccttcacctctgtaattatgttcctttcaaaggttatgatctgatcctgttatgaagggttttttcccattccatgaccatcaattctaatacttaattatatttaccaatcatgatgagataaaagtgctaaaaggttacactgagagtagtatcattttttggtattattaataacagcaaattagaaatttaggataatgaagaacttagccaggccattgtgtggtccataactacttctgtttaccaaacttattacctgaatataaggaactaatgatttaggtatcagtagcaaatttttgcatttatttttaaaatgaaaagtgttgaagccaatgtttcttaattcatatcaactagtcattaagtgttcatgtttcataattctgttcctctggttttgtctttatcatttgtcaaaatataacttttcttttttctttaacccctaaaaatctctcaatataacgaagtcattttcttttataatatttctccaaaattttgagtcctacagtgtcttttttttttacagacctatttgctccaagtctttttaaaatgtgtcttttcttgctatctttgctctctttcttggcatttccactttctataaatgtaatggggaaatggcaaccttgggaactgagaaaacctagttaatgaatgggaatggaatggaaaagtatactttttaacctttattcataaaagtaagtacaattttagcaaagtgtgttttaaaggttacaagatattgagacccgaaaataatattttttatgtattctgcaacttttttcttcccaactacttttatcttacctttctatctgcactatgcccagtaacaactgcatcaatttccaaagttgtgttccacttctcattcttttatactataataaaataacccatatctacacttaactttagtatgtcagatagtgctgtattccaaatgagtgaaaggaatgacaatttaaaatcttgagtaagtctctgtggattgctaatatatatttcattccatgggctccaatgcaaatatactaacaacaaagctcaagccatttcatcatattacaaaagagaattcatttttttcttacttctatttctacagattcatgtagcttcttgcaggtggctgagaaagtttcagatgtgccaaactcaaaataccaaaatttgttcttcattctgaaaaagaaaaggaagaagcaccttaggcaattatcaataacagagggatcttttaaaaaatggtctaactctgtcttgtgttataatagaaaaggtctgaggacatgtgacatctaaaatgtaatagatggtcatataattttcaaagcttaaatgtgggtgccaaactgtatgatggccttgagggaattataagaatgtgttgatctagcagactcaagtacacctttagttttttgtgggttcatcacattttaaaaaacggttttaatgctcatgattcttagcttgttcttaggcaaaaagtgaagaatgtacaatagtgggaaattatgatacagcataaagttttttagttctttcaagaattaactaataatatagaataaaataactaagaaagtaataacaatattatatcaataaaagttgcaaagaaatataattaaaataatttcagtatttaatcttaaagtaaaagactcaaaatttattttcttctatgacttgatatttttggctttttgtaccaggtaattaaatttattatcacttaatgtaactttacaaaggtcaaatagatttttatattatctagtattggatttgaaattttattcttgtgaaaaaaatgcagtatttgattatgcataattctaatagtgatcatgccctcaattagaagacaatacatgtaagtgacagacattttcacacatagaaatgaaacaaagaagtttttgttatggtattcgagtatgtctctcatatcaaattaaagtattctgtttgacttataaatattgatatctgcttcttacattagaatgtaaaacattttgacaattaaaaagacatttggcaaaggccttactacttaattcaagcctattattggtttggaaaatgacattaaacctaatagagtgcttattattatgctatgttaaatccaatagagtgcttattattatgcagagttctctgatataaaattataaaatacaaagcaatgttatattatctatctaaacatagtcaataatgtttaggctctcacaaggttttatttgcttaaaaaattcacaatcccttcatgaatcagtcatattcaggccagtaatctgaaggtcagtataagtttcataggattctagcaccatgaatctttattcttttccagagaatatttgacttagtttatggcctgatttcatatatgtgagcagatataaacagatgatagtgaagtaggttagaggtaaacatttaatgacaagatttgtgggcctgtatctacagatgtgtctatattaaattaatgtaaatgtctattttatagaatggttaggcttttataaatttacacactgaagtcatgtaaaattaaaatattttgctattgagatttatcattctgatgaaaaacatatcattctacagatggagagaaaaatattggtttatacaaagaggtctgaagacattcttaatgaatattttatgactattggaatagtctttctatattcagcaactttctaataacatttttgtgttattcttttctccagaccttccaggattgattcattcattcaacaaaagtttaatgagaacactctctctgttaagtactatagacacaaatataaatgcaattacctttgtccccaagaagctcagaatgttataaacttatgggcatatcagtttgttaagggaggcaggaaggtaatggagggagtatgcctggacatgtgaggcccactgggatcttggttattatggcccttatctgccaggactgagtctcttccctacactgtctcaaaaccacaattagatatcacctcctttttgttaggatggctattttcaaaatacctcagataacaagcactggcaagggtgtggacaaaagggaacatttgtatactgttagtgagaaaataaatttgtacagccgttatggaaaacagtactaagtttcctcaaaaaattaaaaaatagaacaaccatgtgatccagcaatctctcttctgtatatataccccaaagaaatgaaatcaatacctcaaagaggtattgttggaccttatgctaagtgaaggaagccagaacagaaagacaaatcttgcatgatctcacttatatgcagaatcaaaaaaagtcaaatacatagaagcaaagagtacaactgtggttatcaggggtcaagaattgggggaaataaggaaatgttggtcaaaggatgcaaacttacagttataagataagtaagttttggagacctaatgtacagtatggtggctatagttaataataatgtatggtagcaagggggaaaataatgtattatatatttgaaattaactagagtagtagattgtaagtttctatgtgaagtcatggatatgtaattagcttcattgtgataattatttcacaatatatgaaaacataatgttgcacatcttgaatatatgtataatttttaaaaatttgtaaattataccttaataaagctggggaataataaatagacattattttgcgataaatttagattcacatgcagttgtaaaaagtaacacagaggagtccaatgtgcccattacagtttcccccaatgaaaatatcttgcaaactgtagtacaacaggacaaccacaatgctgacattgatacagttaagatgcagaacagtcccgtcaccacaaggttccctcatgttgctcttttataaccacccccacttctacctgcccccactccctcctttccttcgacaaccactaatctgttctctagttctataattttgttatttcaagaatggatacaaatggactcatataataagcaaattttggcatttgaatttctcacttagattcatccaggttgtttcacatatcaacagtttcttccttttatcactgagtagtagtacatggtatgaatgcatcatagcaaaggactagtatttagaatatataaagaactctgatgattcggcagtaaaagcaacccaaacaatttaattagaaagcaagaaaagacataaacagacatttcaccaaaatagatatacagatggaaaaaaaaatgtaaagatgctcaacgacattagcgtttagagaaatacaagttaaaaccacaatgagatatcaccccacacttaacagaatgactaaaattaaaaaaagtaaaaaaaatcttgaatatatataattttcatgtgatttgtacctcaatgaagctgaacataaaaacactggtctattatgaaaaataataaattgagtttctaaatgaaatatgagccaagtattgtaggaacatacttcaatgattcagctaattttatctcaagagtcctgcaagctttagaataaaaggtagcatgtgaatggataagtagtagaaggcaagcagagaaggaagaagagacaagttctgtgcacctttgggagtgctgtatgattttagagtaggctaaataccgactaacaagtgtggtagggtctgtttcagaacatgtaaacaaagttaatggttttagacttgatcttatgattaagaagaagctgacagaagtttattagcagaggggtgacatcgtgaactttgttttatgggcaaacaaatctggcagaaacataaaaatgggctggagtgttgaaatgctggtgtcattaagagaactgtagttattgcaataattcatataaaatataattgaaggcctaaccaaatggcaacagaaatggaaaagaggggctcaattcaagagctataaatgaggtagaatcaataggaactggtgatatttgattttactgatttatgccatacctagattatctctgaatgcatagacgagaataccagagtctaaatccagcctaaaaagagatatgggtttatattttggcaggttctgtgatctaatgtacactgtatcatagtttgaaaatttaaaaaatatatatacgaggttttggcttgtatagaaatgattattccctgtatttccattatgtccatcaaagttcctcacagcgtaattagcattatgtgtgtttctatcagttatccaagatatgctcactttagcaaacatatcacaagaaacagaaattctgagaatttacattcagcccttattcaccatattagttagcattactgctcatgtgcaaaagctactttaaattctccattattacaaccattttatgtttcacttagataaatatatggaggtaataaaatgcacatggtatcagattccacatgacaaattgaaggctgttaaattttatttttttcaaccaaactggttttaggttgtagaaatgcaaaaaagcacatttaagcatttatgctatctacttttatgattcacattagaaaatgatccaaataattcaaactcaaatttgtcagtgaaaacatagctttggactttaagaatatggtaactcgacatttaacctattgtgaaatggtcacagcaaagtcaaatttatcgtattcctggacagattttgtgactccaaggaaagtaacaaaggttctgtaaacctcacaaaagttattcatgtaattattatttgaattaacgtagtaaaccctatgccaatgaatgtaattgtaaatctacaagtttctatttaatgctcaaagtgcttggctaccagatagccaggtaaagacgaagaaattggctcccatttacctggaattttcatacgaactgtaattttgcttcttttacgtatcctgagtaatgtgaactatcagagactttgttcaagcaaaatccttcttgttgctatgaaatttagttaatattcagttcttcaagtttttaactttcaaatgggtaatttaatttccagcaatatattttccttggaatttttcttcctgccttacatgtcttttattttggctttcatcggcttagtaacattaacgaagtaaacataaaacaaaacaaacaaacgaaacagtaaagtaccagtgcattttccgaaaagaataaaaagtaacctaattagacatgaaactcatttctaacaaagatgcaacatacagagggcgatgaaattatctcatttgtcttactgtggaagactcaaaagtcataagcaacaaaaaagttttgacttagtgaaactactctgagaggtcatatttttattttacaggtgcatttgttttattatttttcatgtatttagtggggatttaggtggcacaggaagataatttattatgtagaaaacagaaagacttctactagatactgaacccattttcaagcatcgttaactaagcgatttgacctatattgtatggataacatgctcaacagaggagaaaataaatctcttttgatctttgcttttcaaataaaaacaaaatcataatattttaagtagcttagttaaaatgaaattaaatatttaattactaaggatgtttcagaaatcctatcttttttattagttgttttcacttttgtcctgttattaaaatattttatgtgtcatttcaaatctggttttaaaataattttctcatggagaacatagtttttaactatgttattcagtaactttattttaatactaaaacagtctcataattctatggcatagccggaatttggacttgcttaactatgctggttaatgggaaaggttgacttatagtaatactgcagagtaagtgtttaaagtgggtacatttatgtcatagaatcaattcagttttattcactttttcattgccaagaaacattacactaaacatgggttatagggttactcatttattcctaaacgtagtgaggtattactttaaaaaatacaccacaagtcaaatggaagggccctggtgggacctgattcaccagtgaatgaggagcgtctgaaagctgcagttcagggagagaaaagcactcccagagtagctgcagcagacagaatgttggcagggcacagggagcctggtcggcaaacgagccctaggtcagtgcagagggaaagggaggatacatttgtagtttgtttttcatcacttcttgaagtcccctgggaaattaaatgtcatctgtatgaactatggccacaggtatttgttaggaactaagtcctggcccagttgaataaaatcagcaatttatttttttttgattggcaactataaattcaccaataaagagttatgaaaaaggttgctcaaagtatgtaatagtggcatgaatgggaacttttactcaaatttgtaaaaattatggtatcaaatttaagtgtataaaaagttaggtatttgcttgtagaaacttgaaactacaattttgtggcaattactattcagatgaacacattagtggtggaagtgacccgaaattctacacatgttatagaaagaactccattttatttaaaccgctaaactcaggcttttttgttcacagaaatgtgtacttttttttggagtaagagaataatgttgacaacattattttataaggaagaaacacagctataatcactgcagtggagacatttaatattcacaccgaagaaggcaaacatttttcatatttctagacaacaggtagagatataaatttattcaaatgacagataaaaatgcttgtatctaatgctcattcataagacgtgcttgttaagtcccagggagacaatgaaataagctacagaaacttcagacagaatcatatgctactccatcttagtttataaaagaaaagatggatattctaaaaccgtaatttttaacctgaattacttttacaggactaaagaaactttttttatatgtaagtgtaagaaaaggatgcacccaaagatcaaatattttagtttttaatcatttcaacaattccctatggaaaaaaaaagtggttatttaagtattttgatgtataagaattttctatcataatactaattatttcttacctaaatgttctctagttctctatttgtattgtacattagaactaattacagagcaaaaatggaaaaagtatataagcagtagtgatcccacattgcagagtcatacaaaaacgtacacaaagtaagtccctaagagcagtgataaattcataattatttgaaacgtaaaatgaaacatgtaaaatgtttaaacaataaccaatcatgttaagaattgaatacatttcaataataattaaatctttactattattggctcacaacctgtaatcccagcactttgggaggcagaggtaggcggatcacgaggtcaggagtttgagagcagcctgaccaacatggtgaaaccctgtctctactaaaaatacaaaaattagcccagcgtggtggcgcgtgcctataatcccagctactcgggaggctgaggcaggagaatcgtctgaacccgggaggcggaggctgcagtgagctgagatcgtgccattgcacttcagcctgggcaacaagagcgaaactctgtctcaaaaacaaacaaaaaaaaccaaacaaataaaaaaaataaatgtttcataataataaaagtgtccctaagaaatttattagaaagatttaatgaaatgtatgatagtaataattgctgttgttacggatcatagcactgtctcaaatgagcttagaagtgatgcttccaacatttcatgggaagtagcaaaatctaactcaagaaaccctagcttttttcccaaatgtctctcattatatacaataatgaatgcagcatcacttgaacctttttttcctgagccataaggaaaatgttataggccagaaaggtcatcattagatgacacctttgttcatatttctgtttaagtgcttttatttccctcttctgaaataagccaactaaagaagacaatgtaacctagagctgactaatggaacctgagggaagtataccgtgggcatctaggaaagatttttttctctgatcaagacacatacaaagtaaaagctttgcccctcttttcctatttttgcatgttctcaaggaaaaataactggagatgaagcagccttcttgcccctatgaaggaaaagacaagggaaacccagagatgacccagattctggacagagctgaactggctcatcagcaaccttgaaatagtctctgaatttttactcgtgagagatacataaatagaatcattatttattttgcatattctgtcacttgcagccaaagcacactcaaaacataactcactatgttttataaaagaattttcacatatattattgagatattagaaaacctaaatgaatatttttcatacaatactatttttctaaatgtgaaacttggtagtggctgaaataaaggaggtaaagtagagaatttctgttcaccataattgcttgtttttatcttgtgccaagatatgcagatatcactgaatatgctttcctcatctgacttgctgtccccctaaattttctaagagtcattttcacacttacatgcatgaaataatttttttaaaaaacatgaaacactgcttttttggagtgctcccaatttgcatcagatattttatcactgtcaatgaagtctgtatagaccagtgagtggtaagttgacacttttcttcttcccccatcccacatccaataacttaaaaatacagtcaccttgtggtgtttgaattaataaaatataccctgatgtctgagattatctgcaaaaatatttaagatatggtatttctctataatataaataggaacatgtacagcctagtgaaaattgatagcaaaatgtaataaggtatgtgttcttgtatacacaaaaagctgtagtttatttaattgaattatattcataaataaaaagtgtccaacaaacaaaaattgttttcaataagttttaaaaaataagagggcactacaaatgcagatattagcatgtttccactcctgactttgggtatcaggggaggttagcataaccctctttctggtagaatagaaattcatttattcaacaatctgagcatttactataggtccagtactgttataagaattggaattatgtttatacaagaaaagaagagatctctacataacacttactttgtattagaaaaaatacattaaattatttaatataaattgagatcaagtgctataaagaagatacacaagatggtatgtgtgtatacaataaaagcaaattgagagccttctttaaaaagaaattgaccaggccttccaaaggttcttttgctgaaattccatagttaccaagcaatctggaagttaatttggctttctatggattttgatataattaataggatgtcttaaattatggaattgtgtatctgaatccctggaaaggaattatcatcacctcccctatatattaagtggtatataaattttatagtagataaagttgagcaagtgaataagagcctgaccatttctgggtgtcatgattcaattatgtttccccatttgccaagatgagagtgagactctggactatggatgatcacataatcaaggtagtgcccactggaaaacccgaataaccttcctaggcagcagaaacaactagctggattatactagttgactatgttgagctagacagcaaatagcagaagaattgcttgttcccccatcctctttctgccattcaccagttgactttcttggctctctccctctctccccctccctccctctctctctttctccaccaaccccccatcctatttagtggtctttattgaatccattaagtcaatcaattgtttaagcacaggtgtgagaatataagaatataaagttcatttctttctcttgcctgattgccctggccagaacttccaacactatgttgaataggagtggtgagagaaggcatccctgtcttgtgctggttttcaaagggaatgcttccagtttttgctcattcagtatgatattggctgtggatgtgtcataaattgctcctactattttgagatatgttccatcaatacctagtttattgagagtttttagcatgaagggctgttgaattttgttaaaggccttttctgcatctactgagataatcatgtggtttttgtcgttggttctgtttatgtgatggattaatttattgatttgtgtatgttgaaccagccttgcatcccagggatgaagccaacttgatcatggtggataagctttttgatgtgctgctggatttggtttgccagtattttattgaggacttttgcatcgatcttcatcagggatattggtctaaaattctttttttttgttgtgtctctgccaggcttcggtatcaggatgatgctggcctcataaaatgagttagggaagactccctctttctctgttgattggaatagtttcagaaggaatggtaccagctcctcctcgtacctctggtagaattcggctgtgaatccagctggtcctggactttttttggttggtaggctattaattactgcctcaatttcagaacttgctatttgtctattcacggatttgacttattcctggtttagtcttgggagggtgcatgtgtccaggaatttatccatttcttctagattttctagtttatttgcatagaggtatttatagtattctctgatggtagtttgtatttctgtgggatcagtggtgatatcctctttatcattttttattgcatctatttgattctttcctcttttcttctttattagtctttctagcggtctatcaattttgttgatcttttcaaaatccagttcctggattcatttattttttgaggggttttttgactctctatctccttcagttctgccctgatcttagttgtttcttgccttctgttagctttccaatttgtttgctcttgcttctctagttctttttttttttttttttttttttttttgagacggagtctcgctctattgcccaggctggagtgcagtggcacgatctcggctcactgcaagctccgccttccgggtttatgccattctcttgcctcagcctcccgagtagctgggactacaggtgcctgcaaccacgcccagctaattttttgtatttttagtagagatgggtttcattgtgttagccaggatggtctcaatctcctgacctcgtgatcagcccacctcagcctcccaaagtgctgggattacaggcgtgagccaccacgcccgggcttgcttctctagttcttttaattatgatgttagggtgtggattttagatctttcctgctttctcttgtgggaatttagtgctataaatttccgtctacacactgctttaaatgtgtcccagagattctggtatgttgtgtctttgttctcattggtttcaaagaacatctttatttctgccttcattttattatttacccagtagccattcaggagcaggttgttcagtttccctgtagttgtgcagttttgagtgagtttcttaatcctgagttctaatttcattgcactgtggtctgaaagacagtttgttatttctgttcttttacatttgctgaggagtgctttacttccaactatgtggtcaattttggaataagtgcaatatggtgctgagaagaatgtatattctgttgatttggggtgcagagttctgtggatgtctattaggtctgcttggtgcagaactgagttcatgtcctggatatccttgttaaccttctgtctcactgatctgtctaatattgacagtggggtgttaatgtctcccattattattgtgtgggagtctaagtccctttgtgggtctctaaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaacccctgctttactttgctttccatttgcttggtagatcttcctccatccctttattttgagcctatgtatatctttgcacgtgagatgggtctcctgaatacagcataccaatgggtcttgactctttatccgattttccagtctgtgtcttttaattggggcatttaaaccatttacatttaaggttaatattgttatgtgtgaatttgatcctgtcattatgatgttagctggttattttgcccgttagttgatgcagtttcttcatagcattgatggtctttataatttgacatgtttttgcagtggctgataccggttgttcctttccgtgtttagtgcttccttcaggaactcttgtaaggcaggcttggtggtggcaaaatctctcagcatttgcttgtgtgtaaaggattttatttctccttcacttatgaagcttagtttggctggatatgaaattctgggttgaaaattcttttccttaagaatattgaatattggcccctactctggcttgtagagtttctgcagagagatctgctgttagtctgatgggcttccctttgtgggtaacccgacctttctctctggctgccctttacattttttccttcatttcaaccttggtgaatctgacaattatgtgtcttggggttgctcttctcaaggagtatctttgtggtggtctctgtatttcctgaatttgaatgttggcctgccttgctagtttggggaacttctcctggataatatcctgaagaatgttttccaacttggtttcattctccccgtcactttcaggtacaccagtcaaatgtagatttggtcttttcacatagtcccatatttcttggaggctttgttcatttctttttactccttttttgtctaaacttcctgctttatttcagtaatttgatcttcaatcaccgataccctttcttccacttgatcgaatcggctattgaagcttgtgcatgcctcacgtagttctcgtgccatggttttcagctccatcaggtcatttaaagtcttctctgcattgcttattctagttagccatattcaataaggaaaataagaagtcaaattttccctgtttgcggatgacatgattgtatatttagaaaaccccatcgtctcagcccaaaatcttcttaagctgataagcaacttcagcaaagtctcatgatacaaaatcaatgcacaaaaatcacaagcattcctatacaccaataacagacaaacagagccaaatcatgagtgaactcccattaacaattgctacaaagagaataaaatgcctaggaatccaacttacaagggatgggaaggacctcttcaaggagaactacaaaccgctgttcaatgaaataaaagaggtcacaaacaaatggaagaacattccatgctcatggataagaagaatcgtgaaaatgaccacactgcccaaggtaatttatagattcaatgccatccccatcaagctaccaatgactttcttcacagaattggaaaaaaactaccttaaagttcatatgggaccaaaaaagagcctgccttgcaaagacaatccatcctaagcaaaaagaacaaagctggaagcatcaggctacctgacttcaaactatactacaaggccacagtaaccaaaacagcatggtactggtaccaaaacagatatatatatatatatgtatatagaacaacggaacagaacagaggcctgagaaataatgccacacatctacaaccaactgatctttgacaaacctgacaaaaacaagcaatggtgaaaggattccttatttaataaacggcgctgggaaaactggctagccatatggagaaagcggaaactggatcccttccttacaccttatacaaaaattaattcaagatggattaaagacttaaatgttagacctgaaaccataaaaaccctagaagaaaacctaggcaataccattctggacataggcatgggcaaggacttcatgactaaaccaccaaagcaatggcaacaaaagccaaaattgaaagtgggatctaattaaactaaagagcttctgcacagcaaaagaaactaccatcagagtgaacaggcaacctacagaatgggagaaaagttttgcaatctacccatctgacaaagggctaatattcagaatctacaaagaacttaaagaaattttcaagataaaaagcaaacaaccccatcaaaaagtgggcaaaggatatgaacagacacttctaaaaagaagacatttatacagccaacagacacatgaaaaaatgctcatcactggtcatcagagaaatgcaaatcaaaaccacaatgagataccatctcacactgttagaatagtgatcattaaaaagtcaggaaacaacagatgctggagaggacgtggagaaacaggaatgcttttacactggtggtgggagtgtaaattagttcaactcttgtggaagacagtgtggcaattcctcaaggatctagcactagaaataccgtttgatgcagcgatcccattactagatatatacccaaaggattataaatcatgctacgataaagacacatgcacaggtatgtttattgcggcactattcacaatacaaagacttggaaccaacccaaatgtccttcagtgatagactggattaagaaaatgtggcacatatacaccatggaatactatacagccataaaaaaggatgagttcatgtcctttgcagggtcatggatgaagctggaaaccatcattctcagtaaactatcacaaggacagaaaaccaaacaccacatgttctcactcacaggtgggaattgaacaatgagaacacttggacacagggagaggaatatcacacactggggcctgtcgtggggttgggggctgggggagagatagctttaggagaaataccgaatgtaagtgacgagttaatgggtgcagcaagctaacatggcacatgtatacctatgtaatacgttgtgcacatgtaccctagaacttaaagtatatatatatatatataaagaatataaagctcattagttttaatagagttcaacatatatttaaggagcacctactaagtttcagggaagttaatttaatgtaggtgttgcagtagacttcaaagacagctcagatttcccatcctgaatgatgggcaactttttacaactagaatagacattaattggtaactttgggcatctaacaaatatctgaagtggactcagattattaaactagataaccctgtttaataatatttgcttggcatattcaaatatgaatgacaccccaaatcactaggcaaagcaatctcaaaatgcaacatagggagttcaacatgtgagaaaaaaggagtatacatatattttggaaaaacacatttgctttcatcactgaaaggccagttaatacttttcaattatcttcagtggtatagaagaattttaaatcagtaattatgtaacattagaacatattacatatgtttttcctaaccaatttttagatgctatattttgtaaaacttgcaaaaatcgagaaaaaaattacacctctctagttccttcacacattatttcccttacctatattctgtgaagactaccacagcttcacaacttaaaaaaaatacttctaataaaacttgtttctattctctgaaaattagttaagtgttttttaccttttgtttttcttcacacatcagcagtctttttccaattctgtaacaagaagcataactttgcattttgaaaatgccaatcaccttaaaacttctctcatgctagaaacagaaaaaacagaacagttctcctttttctaatgctatggaagagtggttttacatacacattaattatcttgtataaaaatgataagaaataagaatcgggctacttgaattatattgaaaatattgatatttttaatcaaattgaataattctatagtttaacacataaatcagtaaatcaattattatttagattgcatttttgtcatggatttacatcttgagggactcagatgactccctgaaatatcatgatctgtttttgttgccagtcatgatgctataatttatataaaatattcaagctgacttgtacataaactaattgacagatgtaggaattgtcatttggggattaatcattttgccagtacattcaagtacatgttagataattctaagatgtacgtaaaggaaacatcccctctctttttctctccaatattatctactatttttaaaatgtgcctacctttataccattttctcctatttaaaattatgtccatataaacagataataaatggagacgaattccaattgggaatatttttacaagataaaacttgtttcaatttgcattaccatcaacaaatagccaaatcacccttttttcctatattaaaatactagcaacatgtagcattcatttaccagatttaaattttaaaaagacctgtatttttacatgagtcagaacaaagtgagactcttgtccagagaaatagtactgcagtctgaatctagatacagtattgaaatcaaattctgaatattattggatatttacggtcactcatttaggttagtgactcatttagatacgctttctatactgaacagattacagagattagggaaaatatattactgtcgttttgtaccaatcaataagaaagcaaaatctcctggaggctccgtttagtgggtgatcaaatgttcataaaataaatcataaagactgttcttacctataagttttagtgtccttacattatggcagttgattatcaagaattcattgaacaacatatgcgagcaggacctctatttcttatttagccatttctctaaaaatttggaatttaatcatttgagacagatgagaacaaatgacaacttcccaatgaacataaaagggaagaccacagaaaataatgcctattatttttgctcattaattcattcattcaacaagtatttaatgaatacctgttatgcatgaagcactattctagttgccagaaattcatcaataattgaaatatataaagtttctgccctcatattgcttataatttttatttatctaaatgtgagattagattgcttatataacttagaattaatataccactctctccacctcttctcattcttagagtgtatatacaataaaaacccaaaaaaaatgcaacaaaacatggaacagttaatctagtcaatttctggactaagttttataattaaatgacaattacattgatattattatattattttgtattgtattacatgcatattaatgtattacaatgtactgtttaatacagtggtagactgtttaacgggcacgagttcttcccattcctgtaagcttccttctatgcagtgagactgtgctgctgcttctcccttctagacatgaatctctttctaggccctcttgaatcaggaccaaccttgtgacttattttgactcatggaacattacagaagtgatgcataagctctggatcctaggcttcatggggttcataaatgccaccttccccctcttggagcattgtcatgagacctccatgttaataagcccaggatggaaaaccactaggagagggagacacagtatcctggctgggcttcgcctccagctcatccaccagattactgttgctaaaaaactgccagactaattgacagaaatatgagaaacagtaacttattgctgattaaagccactaagtgttagtctggtgtgctaagaacaaatagataaaagacacataaacgtatataccagacactgtgctaaataccacctatgcaaaattcagcaaaagctttcataatctttgcctatagtctctatcatattgtatagcagaaaagacacgaactgttcaagtattcacacaaatattgtgaaattgctatggtagcaaataaaagaaagaaaagtaaaaatattttatgagagattgtgattcctagagggaagcacatttctggtacaggtgactttaagtgcaaagtccctgtcggagaaagcagcagataccagaaaccaatagaaagaaggcatttgagcctgcgatagagggttagcttatgaagagataagattgtgctagtgggttacggttaggtatttagctgtgtagcatatttgatatatggaggatacagttagtagcagctcttatattaaaaaaagaaaaagaaaatttgggtttctttgtgtatgtgcattttatctttttgagcaattatttgctacaagagcattcaggaaatagaagcaaaacatgctccaaaatatcagcagaggcagtgcttaaatttcattactaaggcttctttcatatctacactcttagagtggaaactaagtaacctaaataaatctaataatgaaaatgaattagagagaaatgagctttggtaattgtgactgtctttcaattgaacaattagactttaacatagaagaaaagaaatatgataggtcaattaaacactgtatataaccaggcaaatcaacaagtttctatagtacaggtcagctcggtactgtgtggccaccgactttattgactcagtacaatacaaagaatatgcaaaattttgaaagtgacgaaatttttctgacactactattattctcataaatgtgccaagtgaaaaaataacaattatttccaataaaaaaaacaactaatgcatagttctgttaaaaacaagatttgctttcctctaagctccaaaaatacagacatagcaatgaacaaccctgaaattcccttcctttgcctgcaagactcacaataaaattattgcccagaagtgctggcaagtgaccaaaatgaggaggcatttttggggattactggcttaaacaataactccttcaaacagggaaagcaaaggaaaaaaaaagaaagaaggaagaaaggaaggaaggaaggaaggaacgaaggaagggagggaaaagaagagaaaatctgtattctttttgttacattcaatcgtcacaatagagtaattttctctcatcatccataaatctatcatcttgctaatacttaggtaaaatcattttcattgtagcacataatatatattaataagctactagactttttctaatattctactttcctttccactttagatttaacaatcatataataatcactgttctgcttgcaaatgaatcatatgcaatagtaaggaaatagctaagagggagatgccgcccatgagagatttaatcataggaaatggctgactttttatttccaataaccatctgcactcatggtaaatcaggtgctaatgaagctcaggcccagactgcacaggagcataaatctcaagaaccaaaagtcgtggagcaacagacctcagaaaaacagaattttctaaggaaatgcaccaaaattatcatatagaaggtcaccatctgcaaacgtgtcacataagtgaatatatttggtaggcctaataccacattatgacactggctgtaaacatcaaatctctacttttcttttgaaacttaccactttcaaatattatgatcacttatggttttttacgtcctcctagatagtcaacatcttgggggtaggggctcttcattccagtttaatttttatcgcctccacagtggtttgtccttataagtacttgatatttggagaatgaataatgagaataaatttattaattgtggaatcctacttttagggcagaaaagttttgcagaatttttttctccagtggaggaggaagccaagtcttaatgcagtagaatttgtaccagaatttgtcttctgagagtcaataaatgtacctatatcttctaagagtttttgtctctcagtaattataatccttaacttcacgtcttgctcactcattgttggagtgatatatgtaaaagaatcagaacagagttagaaggagaagggacagcccagaaccgacagtataaattcaaatcctgtcacaaaatgatgcaagtctaaggacttgacaaaataatttcctttttctatacgctagtataatacatagatcatatctatctcgtaattattaatcattatatttttagccactggcaaatcatatcaaagcaaagacctggtaaagaagaggtatgatatctctattaactcttgaaccaacctaagttctataccatgccacacttcacttagcctcattattctctacttgtttccatgaatgcagaaatcttagtcaagtgttaataagccttttattttcatttgttttctgtaaaaaaatataattagcacaaaaaagaaatctggttgctagagccaattagtctgtaaatagctttataaattgtattaggtaaatattaatacttagagcagcagtttttaattttctgtggatcacagatacttgaagaatttgatgacaggtgtgaaccgtctgccctgatataaacacatgatatatatgtgcagaaatatggctaaaatttcaggagttttacagtcttgaaatccattaatagtacccaggactgtgtaaatccaggtcagaatttctgactatagttgtatttgcaaactgagaaattaacaaagatcttaggtggaattcatcatacataacagactttagatgtagactgttttttatttcttatccaaaaagttaatcaataccagagtttatcatgctagattacaattttaaactgtgttttcatatatccacatgaaatccacataaaacaaaataatgaatcttttcatttaaaactgagaagacagacaaattttaccattcagtgtatatttctggacatgatatatagagttgtattcaggtaatgttatgcagtactaatcagaattcacaaaattagagttgcttacatctgatgagtgggttttaaccctcagaagctagttaatgcatactcctgccccaggcaaactgacattgctgtatcctgaatgtgttggcatttgacctatgggaagctaacatgctgttagtgagaggaacatgtgtatgcgcatcctacaacacattactttcacatttactgctttcttctctttcatttatcttaatacatgacaaaaaaattgacaaatctttgtttcgtaatgcaaattattgcacctgaagccaaatccaatcgattctcaattcaacacataagatgaactgagaagggattttatggcatctaatattataattaggcatgtttttaaagaaaaattaatattaaatatagatgctagtaaaagctaagtatcagatttgagcttcaattttcttcaaagattttctctgcaaaggaacatacgttcttaattatatactttattgtgtcaaaattgtagaaaattaattaataacaaaatacgaagaaacctataacttgcgttatagcctgtagtgtaaggacaatggtctccaatttacatggctcaacttgtgattttcatagtctacaatggtgtgaaagcagtgcacattcaacaaacactacacttcaggttttgaattttgatcctttcccaggctagagacatgcggtgcaatactctcttgcgatgccaggcagtagcagtgaacctcagctcccagccacgctatcttgagggtaaacaaatgatagtctatagtgtactgtgtttccagataatcttgcccaactgtaggctaatgtaagtgttctgagcatgtttaaggcaggctaggtgatatggtttggctgtgtcctcacccaaatctcatcttgaattgtagctcccgtaattcccatgtgtggtgagagggatccagtgacaggcaattgaatcatgagggcgggttttttcccatgctgttctcctgttaatgaataagtctcacgagatctgatggtttcataaaggggagatcccctgcacacactcttgcctgatgccatgtaagatgttcctttgctcttccttcactttccgccacggtcgtgaggcctccccagccacatggaactgtgagtccattaaacctctttcctttgtaaattacccagtctcaggtatgtctttattagcagtatgagaatggactaatacactaggctaagctacgatgcttatatgatgttaggtatattatattagtctgttttcacactgctcttaagaaatacccaagactgggtaatttataaaggaaagaggtttaatggactcacagttccacatggcttggaagaaacttataatcatggtggaaaggtgaaagggaagcaagcacctttgtcacagggtggcaggagagacagaacaggggaaactgccaaacactgttaaaacttcagatctcgtgaggactcactatcaccagaacagcatgggagaaaccaccagcatgatccattcaccgcccaccaggttcctacttgatacgtggggattatggggattacaatttgagatgagatttgggtggggacacagagcaaaaccatatcatatattaaatgcatttttgacatgatattttctttttttaattttaatttttaaatagaattcattttatttggagcagttctaggttcacagcaaaattgtgcagaacatatatagagttcccatatactccctacccccacatatgcacagtccccccaccatcaaaaccttataccagagtggtacgtttattataattgatggacctacactgacacataattatcaccccaaatccagagttttcattagagttcactcttggtgttatacattctgtgggttttgataactgtataatgacaggtattcacctttatagtatcacacagaataatttcactgctttaaaaatcctctgtgttccaccaactcatccagatttttttagggtgattttatgaatcaaatgagatataggtaaagtatttagcactaggcgtggcacacagaaagtgcccactaacaatagccaacattagcattaatcatcagcttgagttgactggtaagagctaaaagtaaatggttgcaacagaaatgaagaaacagatgcaaacggtattttctctgtgtgtgtgtgtgtgtgtgtgtgtatgaaaaaggtagtgtatgtaaatacacaaacagatataaagaaaaagaggtaacacagaaaacactacgacaaagttactgaatacatgtgggagagagagaaaaaaagctaagtgcaaagaatcaagccttgtatgttagtttttactcaatgagatgcaacccaaatgtgattagatacgcaagataatttattagggaaaacgcttgtgagggaaaagtaggtaggcacaggaagagcccgggagagccctcagaccatcatgcagatccgatttctgtgaaagagaaagagaaagaagttctggacagtggtgctgtgttttgttgttgtttttgtttttcaatttctgggatacatgtgcagaaggtgcaggtttgttacataggtatacatgtgccatggtggtttgctgcactcatcaaccccccatctacatttggtatttctcctaatgctatccctcccctagcaccccacccccgacagaccccagtgtgtgatgtttccctccctgtgtccatgtattctcattgtttaactcccaattatgagtgagaacatgcggtgtttgattttctgttcctgtgttagttttctgagaatgatgatttccagcttcatccatgtccctgcaaaggacataaactcatcctttttcgtggctgcatagtattccatggtgtatatgggccatattttctttatccagtctatcattgatgggcatttgggttggtttcaagtctttgctattgtgaacagtgctgcaataaacatatgtgtgcatgtgtgtttatagtagaatgatttataatcctttgagtatatacctagtagtgggattactgggtcaaatggtatttctggttctagatcgttgaggaattgccacattgtcttccacagtggttgaactaatttacactcccaccaatattgtaaaagtgttcctatttctccacatcctctccagcatctgttgcttcctgactatttaatgatcgccattctaactggcatgagatggtatcccattgtggttttgatttgcatttctgtaatgaccagtgatgattatctttttttatatgtttgttggccacataaatgtcctcttttgagaagtgtctgttcatatccttcatccactttttgatgtggttgtttgtttttttctagtaaattcgtttaagttccttgtagattctggatatcagccatttgtcagatggatagactgcagaaattttatcccattctgtaaaattatgtaaatgcacacatatctatctgaaaagaactatctgattatagtttcttttgctgtgcagaagctgtttcatttcattagatcccatttgtcaattttggcttctgttgccattgcttttggtgttttagtcgtgaaggctttgtccatgcctatgttctgaatggtattgcctaggttttcttctagggcttttatggttttaggtcttatgtttaagtctttaatccatcttgagttaatttttgtataaggtgtaaggaaggggtccagtttcagttttctgcatatgaccagccagctttcccaacaccatatattaaatagggaatcctttccccattccttgtttttgtcaggtttgtcaaagatcagatggttgtagatgtgtggcattatttccgaggcctctgttgtgttccattggtctatatatgctgttttggttactgtagccttgtagtatagtttgaagtcaggtagtgtgatgcctctagctttgttatttttgcttagaattgtctgggctataggggctctttttggttccatatgaaatttaaagtgtttttttctaattctgtgaagaaagtcagcggtagcttgatggagataacactgaatctataaattactttgggcagtatggccattttcatgatattgattcttcctatccgtgagcatggaatgtttttccatttgtttgtgtcttctcttattttcttgagcagtagtttgtaattatccttgaagaggtccttcacttcccttgtaagtgagttttaaaagataatttcaacttttattttagattcagggagggcacgtggatgtctgttacatgggtatattgcatgaagctgaagtttgagataaaaatgatcctgtcacccaggtagtgagcatagtactcaatagtttttcaactcttgtccctgatcttctctccatgttctagtagtctccaatgtctattgttgccatgtttgtccatgggtacccaatgtttagctcttacttataagtgagaacatgtggtatttggttttctgttcctcagttaatttagttaggacaatgacctccagctacatatatattgctgcaaatgacatgatttcattctttttatcactgcatagtattccttggcatatatatatataacacattttcttgatccaatccaccacagatgggcacctaggttgattccatgtcttggctagtgtgaatagtgctacaacgaacatatgagtgcaggtgtctttttggtagaatcatttattttcttttggatatatacccagtaatgagattgctgggttgaatggtattctgttttaagttctttgagaaatctccaagctgctttccacagtggatgaactaatttacattcccaccagcagtgtataagcaagcattcccttttctctgcagcctcaccagcatctgttgctttttgactttttaattatagccattctgattggtgtgaaatagtatctcactgtggttttgatttgcatttctctgatgattagtgatgttgagtaatttttcatgtttgttggcagcttatatggtttcttttgagaagtgtttgttcatgtcttttgcttgttaaatagttttgttttttacttgttaaattgttttgtttccttatgtgttcaaaatattagacctttgtcagatgcatagtttgtaaatattttctcccatcctgtatgttgtctatttactcccatcctgtaggttgatagtttcttttgctaggcagaagctctttagtttaattaggtcccacttgataatttttgcttttgttgccatcacctttgaggactgagtcataaattctttcccaaggccgatgtttcctagatttccttctaggattcttatagtttgaaattttacattgacattacttagcaatgagggagagcacaattccagcacctactgctgaggtattttccacagttctggctgtggaggctcctacttcactccagagcaggcatgccaatctctggcatgagactaaaatgcctccatggccatgctgctgggtctccaaagaatgactgactttgtatgcacctggattaaaaatggcctcctgctcttggtcccaagtctgggaaaatgtctgcagcttttccaagtgcctttctctttcagcgcctccaagcctctctccaaggcagttccagtgctcaggagaaacaaaatgctcttccttggtctaggttgctcagatcttcagtggaaatgtgagtcacagagggagactctctgtccctctcacctacccgggcttcaatcacgtttatcagccagatgctaccacgggagctgtctgccaacaaccccgggaactggggtgtccttcatggttctggttgattccttttttccttcttgaattaaagctcacatagttgatctttatgtactatcctgctacctccaagtggctgaggcaagctacctctaatctgccatcttgggagtgcgtagtggggggaactatatttttaatttatggtgggtttatggtgaacttaacctcatcataagttgaggagcacatgtacatcacttgtgacaacaagtagctgacaagtgaaagaaacacatggcaaagtaccaccttgataaatatctttacatcctttgacttggctgctacttgctttttgatatctttatcattatgagagatgtgtataacagaaagaattacagatgatgatttcttaaagtgattagttactaaatataaattatatttatatttattaatctatactcttatctactcaccttgttttaggggctcatatactttcctggaaaactatatataaatagtataaatggctattttttcaaacattttagctctagaaggatttattcaagtttatccattgaatctgcccatccatatctgttttacttctttagtcctactaattatccagtttattattaccttgattattgaatcaatgcaatctgacaaatatttccattttccccttctgggagcaaggtgggagtatatctcctggccattttatggaggggataaggccacaactctacgtttgatccataaggtgttaggaaacatgatgtgggtaatttcaagtctggaatagttaattgcccacatgagattcactggaattctctttccttcttgcacattgaatgacaaaattcgagttaacggccactgtgtcatcttggacccttgaataaatacagaaacagagctctgcaacccctgcaaataatttggaacatgacagagaataattctttgtggatttaagtcattgttattttggggctgtttgttaccttggtgtaacgcttcctaacatgtttaaaacattcactaatgtgtcttttcaaatacagttgttccacttccaaattattcttcagaaaggaaccacatttttgtttgtttctatttgtgaaacagtaactgttgtattgcataaaaatgacagaaagatgccatcataaagtaaataaaattttaaaatttgtcttacatttattccgtacagtgagttctttgccaaaaataaaatctgagttcagtaattaaaatgctagtctcatcaaagctctgaatctaatttaaagttgagattacttccctgccttagctattggctgatgcaagaataaagcccatgaaaaagaaagggaagggacaacttcttcactcatttctcacctaggacttcttttctcctgctctatcttggctatccatattctctgactcctccaattcagaacaagcagtagaagaggtaaggagagaagggatagttcttccttgagtggtaccatggtagatgactcccactagtattttctactttttccatattttaaaattcattttctgatgggcccgtgctttcattttttcatttttcattttttcatttttctgagatttctccctatcctttacacccaaccagtccgctgacatagtcaagtgcatgttttgagtttatccttatcccctaggcatctgccaatttaattctcatttcctctgctgaggtccccttgcccttcctgaaagatctaagacagtcacagagcagctcatgctctcctcttctcttctcctcttccaatctctctctctagcccacatgctgaatttcaccctggcaaactcagggtccacaacacttcccgaactgcaatcccctactctactatcaatagctccccaacctttacttgctcatatgtgactcatacttgatgacctacaaagcagtggatactaagacctccaagcgagacattaaacctcctcttttgactttggtttaggaggggttaccccactgggagcgatgaagtggacctgacagcatatctccctccagagacacctcttaaaaacctttcccctctccccatgggcgctcttccatatttttggtttgatagagtgctttaacagtcctcaaactggttctgcattagcatctctctttgcaatgtgcctcagctgaaacttccattagaatcatttgcaaacagaaatcaagtcttgccaactccacctgtctcctataccctcaccaccagcccccgcacacattctgataaaaagccttcagagacttcatttgaatttaggattaaaatctaattaaatcctacatgatctaaattctgcctgtcttaacaaccctttggtatgataataagagctagtcgcatgagtctcctgtttctcttatgaaagaactctcttgccgtacagcagggtttctcaatctcaatactatttacattgattgggcagatacctctttgttataaggcactgtcctgtgcattgtaggatgtttagcagtatccctggcctctatcaactatatgtgattactacccccaaccttgtcgtgacaatcaaaaatgcctccagatattgccgaatgtctcctgaggagggcacagattgtccgtctgttgccttagaaacttcatatgtgatattccctctgtctcaaagtctatcttgctcattctctacctaaaaatttcctactcatctttatccctgaatgagtttccaaaactaagtcagttcttctggtgataaagcatctcaacattacttttcctttgtagctacacaggtggtttacaacctccctctctccgcctcccacagagatacttttggagcattggtttatggcatatgccacatacccaggccactacaacaggatgaggcctttataatgcaactgaaggctgaggaaacacccagacctcgttggagaagcttccaggcagtgtaacagttttaattttctcttttctcttttagatatgtcattggctgaatcaaaagcctttgctgatgtttcttttgtgagtagaatggatgaaactgagtgagagataataataagagctaagaggtaatgaacatgtactatgtgctttacataaaataatacattcagtcctcacaatgaattagcactagctagcttcatctgacaaaagacaaaatcacaattcagagagaataaagtattcatttcagatcaggtattggcttcatagatctgccttgattcttcataactgctgttccctctgctgggaagtttcttccccctattaaccacatgcctttcctcctcaccttccaggtctctcttcgaatgtcaccttctcaggtaggatttcttgagtgctctatttaaaattataaatagatgcctcacgctggcatttcctgctttgctttcttcgatagcacttcctgccatctgaaatgctgctgttttactttgattgcctctctcctctgaaagactggaagttcttcgagggcagtgattttcttgcaaggctaaatcctcagtacctgaaacatgcttcacacttggtgagttcaccataaacatttgttgaataaaggatgagtaaatttcaatcctctacatgaaggtcttagtatttgaactaggcatacagtcttggggtgaaatgttggttcaaacttgtttcaagaatgctttcattttagttttctagaaacaagaatactgaccatgcaaattgtatacaggtaatccagggtacatacagataatccagggtaaaagagactagaagtgactctctcctgcctccatagttaatttctagagaggaaggccctgaggcagaaagcaggtagacaaccagcttgcacttgtgttggtggcctgtcagccagggttgagtttgacctggcccgaggcacccacagcagctgtggccaaaatcagactgggccaagagaatttttcatggttcaccaagatcacctgctgtgataatctaccctggtaacattttatatttctgaaaattcgccttaatttatataagtaacctaaatccatcatgctgtttttaaaatacattttctatccttcttgtctcagaaattatagaaacagatgtatactctcatcacaaaaataaccttacatcagatgaaaattttactaggtcatgcccccaaaattaacaaagttactaactatgcaatttttcattttatattaaatcatacgaataattttcctatctccctaaacccattaaaagtccagtactttatagcagagatgacattgaatgattcacaaattaatgaaaccattgttacagtgctttaaattttaggaactagaattataaaaaccttataaaaccatgactccccccagccccttcagtagcacatgtgttgcctgtttgaatactaaacgtgtgagaagccattttatgaacactttgcactaaataacttttctaggatgaataagggtgcctagatatttccacagaggcagattagtgacattcaaattgtaatcttgttcctcgaagcagaagtaagcttttctataaaggacccaacttgaaagggaaattttgctgacagtgagagtttgagtttcagtccctaaagccaggggcaagtttttcaagagacccatactgcaaggccacattgtggactatgtaacttcagctaatttcttggaaatgtgagtataattgtctctgcattttacatatttaagtgatatgatgtgacagcatctgggttataggatggggggttctgaaccatgagaacccctaaatttgagaccgttttgtgtcaggatattctgagctctgtctcaagggattttttcctctgacccacagtgcagaattgtttcctgattaggctgtttcaaagctaaaagggacaaaaatagggctgagcagccagccagccaaatgtaccttttataaatctatctctaaacttgtagagaactctaacaatggtttcattaatttaacaatcactcaatgtcatatctattataatgtactaagctcttaagagagaaagaaaaaagaaaattgttttattcccgtgatttaatttaaaatgaaaaattgcattgatggtagtcttgttaaactttttttgatttgctttatgatttaaagtatggactttcttttcttgagggccatgcttctgtcttctattttaaaacttctaaataatcattcttatcttctaggacaggtatgaaaacacttgataagtgattttaataaaaacatatactgtgtacttgtaacttggtaacaaacgcagccaaaaaggttgcatattgaaacagtgtatatccaaaccgtatacctagcttggcccccaagatgcctgtgggaacaatgaaataccctgactgatccccattgctcaccatgtagcttactttggctagatcactttcctgggtccctgggatcttcctgggattcttgccaaatccagtttccagttcccagggtaggttatactccttttgcacagttcttcacagccgtggtttgggattgtcccatcaaagactctttgtggacaatataatactctccctttctcagagagctcctttgataatgtcctaaaacttctgtctttctaatccacaaaggatttttcctaggttcagaattttctggatctgctagcctactaaaatccccctgtgattctggagtatagtagaaacatcagagttacttagtcagacattcttgaaatagattagactttaccaggggtgactgagccaaaattgttacatttcgtaaccatgaaaatgaaagacttccactgaaagcaggacatattggaagacaaatgcatttgattctaggctcatggggtcccttttttctgctactaattttgaagttgacctctttacgaacattgattctcttttgagatccagtcatttcaaggggaagagaagatgatattctaatccatttgcccacataaacagagtcaaaaagcacgataatattaatttcttggttttgaatattcatttttagtttgaaaagtgtatcatgattatgtaagatgctaactttagggaaaagtagataaaatggattcagtttatctatggaacatctttgtaaactttctgtaaatctaaagttattccaaaataaaaaatttatttaaaaaatttgtggatgatagaaggggacctcagtgattcaaaaagtcacttaaatcccagagaatgatacaatcaatatttgtagaggatagaaaatgatccaacacctctcctagctacattgataattaatttgcattagagactgacatcaaatgcctcagcctatatatgtttctgtgtaaaacactcagaattagaaggaggtctgcagcaggacatatactgaaaacttaaaattcaaaatgtgcagaaagtcccttattttaaatcaacagtgtacttaaaaatatttacctactcattttcttcaggcttcctttatactagatgattatgcaaatagaatttaaaagggaaaaaacaatctatgtttttgctcttgtccattataaatatttacgcattttggtgaagcaggaaagtggttgttagcaaaactgatttggatggataggaggaaattttgattaaaaataaagtaaagcataatgagattggggaaaatgtcatctgaggaaaaaaatctcattttttttttcagtttttaccaacatccttttttgagagtactgcagacaattatgtcacatacacatttttaagactttttcccattacactagacttcttcattttctaaatttgttatttgtaaatggaattcatttctctggcttcattttcttgtctcattatgctgaattcagcgagtgtttgttttgaaaccctctttaaataagagctcccatttcttttcatcatctgtaagttcttaaccatgtacaaaatcatttttgttgaaccaactttccagttcacgcaccactgctactagaaattctaggatgaaatccatcattaggcgactcaaagaaattatggagtttttttttttttttttttccactttctgtttcttgctagttattgagaaatttggtgattcagagaataaggaaagagagtggggagcgctctgactagtgtctagtaaccccttagtggatgacttcagctggctttaagcaattgctttttttattttattttttattgttttttgagatggagtcttactctgcggcccaggctggagtgcagtggcacgatctcggctcactgcaacctccgcctcccaggttcaagcaattctcctctctcagcctcctgagtagctgggattacaggcacgtgccaccacgccagctaattttttgtatttttagtagtgacggggtttcaccgtgttagcgaggatggtcttgatctcctgacctcgtgatctgcccgcctcggcctcccaaagtgttgggattacaggcgtgagcgagcgggcccggccttaagcagttgcttttaatacaataattcctctcccaaagtgttgggattacaggcgtgagcgagcgggcccggccttaagcagttgcttttaatacaataattcctcttctaaattcactgtgaggctgcagtcaggaattggttttggtaattgtaaagtccagctgaagtgctggtggaaactctatactaataagtgcttggcaattatagttatgtccccattgaagtgatccaatacatgttgcgtacttcgctatatccaaaactggcagaaatttgtcttcagtgattaaaacagttatcactgcccagccctaaaagatttataaacactgtatacatttagaaaccccttttcaatctaaaaataaatatataaataaataaataataaaaataaaaataaacaatggcagcatgtttttaattatgcctaattgaaaaaggaataaaatcatttggaagttaggtgaagaaaagaggatgaaaagtctgataatcagtggttattctaaagaaaataaaattcttctcaatgtaaatcatataaacataccagagtgctttaaaaatacagttaaataatcacattgttttactgttttggcaaaagttccatttagcatagaaaataaatatcactcatattgttttcattttgctttatgtgttcaaataggatatataccagctctacacatcatccaaatatataattatgtggttaattatcacaacatagtgttattcttattaactttaaatattttgtgattattagaaaacaaatttaataataaggagtattcattgctttcatcacacattgattaaatatgtttttctgagggtctgttgagtgcaaagaattgtgctgtaatagtatatattttttccaatttttctttctaactgttgatttcttatttccttagcaatcaaagcatatggactatattttaattctacagacattgcgttaggcagaacagctaccaacacccaatccctgaaatttgtgattatgttttgatacatggcaaaaggaactatgcagatgtaattaaggttaagaactttaaaataggaagattaaatccaaggagttcttcaaagtaaagaactactacatgcagaaggtatgtgctgcctggggcacctcgtagttggaaggaaggctcctcacagtgcatgatggagctgtgggcgggaaaacaagagagaaggccattggctgagagctcaggggctcgttctctctgtgctgccatctctaggtgagaaactccagtgttggaacctggccttcaatgttgtcatgccaaggtaatcaataaggtagagcctcttttatttaatgccaataagcaagtaggtcagggtgatttaaaactttttaaaatacataggaatgtgctatgtgggtctccatttgtacttttgctccaggtcctgacaatttcagtcataggcctgagataataatttgaataacggacttattgaaggcttagtgaatgtcctctgtgtgttggatatcatgcagactgcttggcatgtactatttttttaagttcagataacaattctttgaggtaggaataatgtgtgtacatattttagagatgagtaaatgacattacaggagtagagtgatctaactaatgaatcttaccaaagaaaagcattcctgtgaaatctgtgtgactaaagggagggtagaaatagttgtcttccccagtttcctcttgctttgtctattttctttagagatgcccaggctggagtgcagtggctatccacaggcgtgatcatattgaactgcagccttgcactcgtgggctcaagtgcatctacctgcctcagcttctccagtagctggaactacaggtgcaggccactgtgcccagcttcctcctgtctctagccacactgtaatcacaaatcacaaaagttttcttaaattatattggtcccagaggaatagtaatgatatttgctacagtttcagtttccatctgtacttaaggaggaatagcacccaaactcagcaagcaacccagagctctagttcttgattctgcaaagtttttgttatagtaaaatcttttgttttgtcagtatgacttctttttggagtctgagttatgcatttgacatgaattcaagttcagttatcattcatctcctttgtatttacacaaatcaattaagtctaaactgcaaatagtttttgtctcaggttcacctctgataggctggtagcagctgtctggatagtcccgccaagaaggatcgagtagctgcatgtagatgcagtaagaaagagcacaattagaagaggagactggggatatgcctaccatgaatttcttatccgtaatcagtagagcccagcccttgtgcacagatatacaaacagtggcaatttttttttttgtccaccaaaggattattcaacaaggcacatacaacctatagagaggaagatgcctctctattcactcaaatacatagtttttttttttttgcatttccaattatctattgctaataatcttttcagtgcttacatatgtgcatgcctgtacacacacacacacacagacacatacacacatatatcctaaagtttgtgaaactatagtttgccttatggaaggaaaacacttgatcctattcacaggggtaatttttagacatctctattcataggtataaccagcttagaaaatttactgctgtattaagggtcagaatagcaactcacaggaaattgaacatttggagaacccaataggtaacttttaagagagaagtatttatgatatgaaggaacataaaagttttgtttttactccctttggttttcttctgtaattctagattgggaagaaataacagagagtgcttgaagaatagatgtggctaggacaatatctctgaatctctgaatggcccatggtggtgacccccagccagagtgaactgtgcagcagcaatggtgcccagtgggcagcaacagtggaacagaaggtgaggaaggggccagaaggaatcctttaggaaattaagaaaaggataaaaatatgataaaaatgtggtgtccaggcgagaaacggaataacctcatccctgttctgactaacaatttggtaatattttgacagttttgaacaagaacttccttctccttttcttttggagtacaccatagtgaaagacctatggtaaaaaacaaggtacaactggaatactgctttttgtttttctattttcaatagtatctcctgtttataatggattgttttaatctcagggaagaacatctgaggagatcaccgggtctctaaataccagttcttgtctctgcacaccttttttaggggggactgatgcctggttatatctgcggtacaccagttcctaaagcaatacctaagaaagtcaatgtttcctagataaacttgactttcatcaaatgatatttagaatcagttttaaacttgtagagtattgcaatcaattatgatcatattttgcagcatatatcatgaagtccaaatcattttagcttaaagaaaacagacgtctattattttttcacttagagtaagtcaggaagtgtgtagtcttatgtgttggctttccagtgtcatcaggggcccagattcctgtctttctgctctgccatctccaatgtgtggtttctaacctcatgatccaaagtgggttcttttgctccagcccgcgtatcaatgtaccaggccagtagaatgaagaaactaaggagagcaaaaggaggctccttcctaactgagtcaactttctttaagcatttgtcctgaaggtctcacacaatatttttgcatacgtctcacaggtcaaaacttagttatgtgtccacacaaaatttcagaagaggctggaaggtgttgtcttttagctgaatgcattatcatcctggaattcaaatctgggttctaatagtaagcgagaaagagagcgtggttattaagtggtgtcatttggcacagcctgtcaacagaggacatgttaattggcattcatactgatgttttaataaagcatgtagtgtgcttatgaggaccaagattgaccatactttggtcatcatcaatcatggactgaaaggcttttaaacatgaggtatgtaccgcctagcattcagtaacaacccacttagtcattcctaccttaattttaggtgcatgataccaaaatgttaacatatttgagaaacagtccaagctaatttaatttacgtaagtacatttttagataagacaatgataaatttgaaaatcagtttggtttaatgattggttagttaaaaatatatcaaataaataactttttctaccttagcatttttaaaattctggacctaaaattattacattctatttagggcaaggattagcaaaatacagcttacaggccaagtttgtcttgacttccttttttgtaaataaagtttttttgaaacacagttactctcatatggttacatattgtcagtggctgctttcactctatatcggcagaaccgagtaattgtattagatacccccaccactaaacccaatgtgtttactatctggattcatacagacaatgtttgctgacccctggcataggcaaagcaaaatacatgacacaatgaatttccctcatacttagaagttagggcccacagaactcacctgaaaagttgcttaatagttacttaattatatagcagattaatcagtttttaacttgattctgacgttcctaaagaatggcaaattccttcctaacacaaactaaacctttacctccgtggttctcaactggggtcaattgtgtctgccagagacatctggtaatatgtagagacctttttagttgtcacaagttggggttgggaggtggctgccactggcatttgataggcagaggccaggggtgctgccaaacgtcctacaatgcacaggaccgccactcaacacaaggaactatctggcacaaaagtcactagtgctaagactgagaaactccatggtaagtgagaactccctaggaccgaataggtagttgtcaataacaaaaaggaggaattactttccttaaaggtaaaaataattgtggcattcggtaaaaataattgtggcattctttcttggtggtggaggttttgctgtactccttccttgtttttattctccgaatgaaaacaccatttttatctgaattagtagctcaaagttttccattaatcacctcaaacggactgacacagtgtttcacacacaatgtcacgcatgctgtatgctaactcctgagttttgttctgagggagaaaaatgaattccatggccaaaagtactagaggaagaacactcatcatatcatcatctgggaggttcactgtttacctccaggatattaatggcactcagaagactggtggtgaagaaacctaggaactgtagaaatgtaaaacctgatgaggctgctatttgtagactaggtccagggaagatgtactaggtcagaggagaagatatcatggcagaatcttctaaacagtttttcatggatgacttattcatacatggtcctcagacatggtcctcagagtgaaaaataaaagaattcctaagtaaatgaatttggagattactaccttttacagagtttaacaagttcaattatagcaaaggcttttaaccctctttttctgtgtgtgataaatcccattggcagtcgcagatctcttctcaaattaatgtgatcaaatgcataaagcaaaatgtatagggtatcaaataaattgcattgaagtgtaattaacaaaacaaaaataaactggtgatatatgaatgtaagcatctctttattatcacattaaataataagatctagcagtaggtctactaactaccatacttttaaagtagtagtgagtacaaataatatttcaagacagctgcaataacggtgatgtgatatgaaaacatctgtcatttttgttggggacaaagtcacaagtactgccaatattactacagcttgttgtcttcattcaaacggaagaaaatgctaaatttcagtgaagtgaaaactaaggtttaaaccatcgtagagcctttaaaatgttatgttacttgtgagtttccagaagtaatggttgtgggacttgtttgaacttatttgaacatagaaactttaatatattttgaaaagataatttcacatgccatgtgggaaatgttgccttgagctagtgctgtacgcctgaaagcttctaatgtaatgatgcagtattgcatttataatcattgttttaagctagcgttttcaaatccagttcagctccatgataacagctgttgttttctttaccgatgtatttcactttcagatatgattttttaaaaatttctttgaacttcatacttttcttagcaaatatctccatttaaattctcagaatgaaaataaaaatgagttgtctcacacctctacacttagaaaatctaggctgcctgtggccctttgccctaacacgtgactcctgtatcatgtatgtataactcccttctaattaagcaacctcattcatcaagaaagccctgcagcgataaggtaatttttgccacaggaatgtgacactaccatgtgccagttgctgaaatagttgcacagattttagtgaaatgcaagagataagtgagtaagaaagtgaaaattgtcagcccataaattactgctgccctcagtctacagtaattacagcaaagctgtagataactgtccctctgatgaactctagcaaaatggtcttttaagtttatcagcatattcaggtacaactctctcaggaggcttggcctcttctaaatgatcaaatattctgagggtgggtggcagaaggacaaaagatgaggaaaaaggaaagagaaacattatttacatcaattaaagtaatttttaagtttattcttttaaaattatctagtagaagccttctttctcacttatgattcctttaaatgacacttgctattttaatgactattaaaatagtcattaaaatattaagtactaaatggtacttgctatttttattaatggatgccgaaagcagtcagggagctaattattatattgtgaaagtaaaaatatatatgaggctcatgtaaaacagttttgtttgtttcttttgattatttatttatttatttatttatttatttaaagacagtgtcttggctgggcgcggtggctcacgcctgtaatcccagcactttgggaggccaagttgcgtggatcacgaggtcaggagatcgagacaagcctggccaacatggtgaaactccgtctctactaaaattagctgggcgaggtagcatgtgcctgtaatcccacctactcaggaggctgaggcaggagaattgcttgaatcagggagtcggaggctgcagtcagctgagacggcaccattgcactccagccttgtgacagagtgagactccatctcaaaaaaaaaaaaaaaaaaaaagacagggtctcattctgttgcccaggctggagtgcagtggcataatctgggttcactgaagcctcaatttcctgggctaaagcaatcctcccacctaagccttcagagtagctgggactataggtctgtgccaacatgctcagctaattgttttgtttgttttctgtagagacggggtctcactatgttgcccatcctggtcttgaactactgggcttaagtgatcttcctgactcagcctcctaaagtgctgagattacagttgtgagccaccatgcctagcctcatgtaagtttagagctataaacttaaatgatgggtcatcagtcatattactttttttccttttcaacatttttattatctcaataatcttataaggtgtggaatctactattattcccattttataggttagtacaggtatcatcagttgaagtgtccttttcttttttttttttttttttgacacagtttcactctgtcacccaggctagagtacagtggtgccatcttggttcactgcaacctccaccccccgggttaaagtgattctcctgcctcagcctcccaagtagctgggattacaggcgcctgccactgcgcccggctaatttttgtatttttagtagagacgggtttcaccttcttggccaggctggtcttgaactcctgaccttgtgatccactcgccttggcctcccaaagtgctaggattacagacgtgagatgtccttttcactctcactgctagaaaatggtggtgccataatttggaaaaaaaaaaaaatcttctgcagatttggtaaaatgatcctgaaataatgtgaagccaaaaaaaaaaagtggatatgcagttgttctatgtttaaaactattaagcaaatatatacatatattcatttaaatatatatacatattttaatatatacatatatttaagtgtatatacatacttaaatatatatgtatgtagatgtgtgtttgtatatgtgtatatatattatatataaaatatatatatctaagtaaaaaagacaaattaaaaatactaaaaagacaacagtgctgattctagtctgaggagataataagtcatcatttcaacacttaaaattttatgtattgtcgaaattttctgcagtaggtaactatacttttattggcaggaagagaaattcttatgaaaaatgattgatattatatcttttaaaattgtaagaataagtaaattagtaaattccaaagttcaaacattaacttctattgataatagagttttaaaaattctttcaggaagatggagaaaaaagaagactgacaactctcccaagcagcaccatttccaaaaacatttacaagatagtggatgtggtggtgacaactgaggaaagagcacagagacaaaatcagaagcttgttgaactccttctctctctcctaccaacctggaacagagggcttttatatagaatttcaagtgctgtcctttacccctttgttaactcattctaagcatgaagacaagcactcttggaatgatcatttaaaacagtcactgccctttcatgatagcctcctcagaccttgccagcttgaacaataaattacaaatcatttttttgctgctattgctgaggtatagctttcaatattatcactgatttaagagttgatgtattttgaaaagtcagactaatatggcagcatttcggatgaggcctcttttgtgtgtctgctttattcctttgttggagttccacattttctttgtgtgggaccgaggaatcatggaaaattgccacttgtgtgataaattactgttttcacccatcaaacatagaaaatgctccatgtgagccttgcacaccattatgttgtcccatctaggaccctttgaaagtcagcagggtgcatctggctgaaattcagtcaggcgattaaatttattcaagcttggtgaacttgagagctttcaaaagaagagtagctgaagggatgagattatagtcctgacagggctctggaaagggtgtctgacacctgacggctcacagcgagccatggtacctgttcccattgatttgcaacaaagtctttctcaataagtatttccacttaacatttcctctcagggaacctgtgccgttgaagatatttacaagttgctttcagcttaaaaataaatcacctctaattcctctaagcgaaatcaatcaaaaacctgtaaaaaatggactggttgtttggtcgattctggcagaaaagtaaacagcacttcagcttttctccgccattaaggcctaaatggcctagaaagtaaatcaatatttctagtcagccttctggctattgtttagccagtagatatggatttctctggcttactgaactcctttgggactagcctataatcctctgagaggaataataagttcgttatctagttcagctctctgttgtacatttaaatggactacatccatcagcagcccttgttaaagttaaagggtgagggcatcccattcaaccccctttagagtgagacacttccaacacagtgagggggaaattataattcaaagttctactggttggcaaatggcctaaaaaccctaagtaagggtgaggcagtaatttgagtatgaggaggcatatcatactgctgtttcaagctaggaaatgctacttgcccatttctgagtatactatgatacatacataagggtatttgctagagagtctctcattattcctactagtccttcttgaatgtttttatttaaatactcctgtgattctgaacagtaaaagctatcagaactttcctgatgtagcaaaccaacatgcttccacctctccttgtcagcaaatggagaatctcatacttctactaattttactttaataatttaaaaatgactgtactaacagcttggcaatgcagtttttgagggttttagaagataagaatcctggataaaagaccattccttgaagaaattaatttccccttgcctttcaacttgataaactaaaattctcctttaaattccatccatgtattctggcttcatatgaagaagtgataatgtaggaataatttattttgagctattttatacacttaatttttatattattttgttgatttcttaacaagagccacaaagacaaaaatgaattatgattacttgaaactttcaaatgtaggtatttatggtatccaagacatttctttaacaaaacaaaaacaatagtgtttccaaaggtcccaggtgtctcttattaagtcttggcatgtatttcatttagagattgttttcataattttttaaagtaaaattatcacaacagaattaataaagggaaatataattatttagataaaatagtcacaatagaatttagaaggtagaatatgtatgcaacatatactcatttaggaatgaaagttattatattaatgcctaatattgagctagcctatgaagctgacttgttctgtagagatttttactgctgccttcttcaaggactcacctcttcaattgccagaaagtttgttttagagagaatacttaattatttggaaatcttttatggggaaaaattaaattcagtaaaaatcaacctaaaagtttgtattcaatttgatacgtttgttaactacacttgctagaggtattttgtgattaaataataactttaccgattattaatgccacattaaattcacttttaagaattcagttaacaactatttttgcatggaaatgtagaattttatctattttggtttttgctgtattttgaagaagtctatgctgagaatctgactgtgacagattttgctcctcataagccaagtcaactttctcactatcacctttcatattctccaacttatttgatggctgatgttcttcccaggaggagataaaaaggtgacttgaatgataagggaggccagacatggtggcttatgcctgtaatcccagattttgagaggctgaggcaggtggatcgcttgagcccaggcaagaccagcctaagcaacatggccggtctacaaaagaaaaaaaaataaaaaaaaaaaaaggaaaaattagcccggtgtggtggcagatgcctatagtcccatagtcccagctactcaggaagctgaggtgagaggatcacttgagcctggcaggttgaggctgcagtaatcacaccactgaactctggcctgggcaacagaatgagaccctgtgtcaggaaaaataaaagaaagaatggtaaagacaaagggctcttctccgtcttttagatatattgacacttgattttcatacttttaattcttcagtagtgttcacatgcttaaagttaaaataaatgcaaaatgctcactgtattctcattctaaaattgcgttggaatgatataatattgagagactttactaatcatatgaaatgagaatcagatagaaatgatagaatttatttgcaaaattgagttgatttttcatgtttgattatacttcaacatccctattaaagttttacttaaatggtgtgaaaatttacataagaactataactcttagtacatttataatatacatttcatgtgttttccaaaacaatttggaaatcaggttatgtctgcataacctgacaataccaaaatgtatctatctcttacttgtcaggaaacatttcttaccaactgacttggaggtatgaatgcatgtaaattttctctgtattagcttcatttttattctgatgtttgagaaacactaacatatatagagaaatattattatatcaataaggtttaatttgccagtcaaaacctttcaagattataaggttatagcctttatctgggagttgtcagtactggatgaggttgccaacacaaaaaggtagtgagaatctagttgtttattttgttttgtattgcgttaacatgatataatcacttttctgagaaacataagttatttctgcatcctcataattatcagtgaatggaacgtactatttattcaacacatgattgttaaaagaacatataaataaatgaatatgtaaatgaatatatatgactataaattaagactactattttgtttctgcagcagaagcttagacaatttattaatgtgtgtccctggggtcttaccagggcatgcagtggcattgacagaatgaattaactgagtgaagctgttttggtgctgttgtctaaactcagaaagtggagagtagttgacaacaaaagagtttggtcaaatcctattggaaattccaaatcccattcgcaaaaagtggctataacaaacaattacaatgaataaaataagaatttgatcagtcacattcgactgactagaagacatttattctatataccaagatagctttggaataagaatttctctaacatcctttcacataggagataaaacttctacagaaatagctctgtgctacatcaaaagcatttcagggaagggctcagccaattataacctgagggccaaaacagacctgttttttgtttttgtttttttttttttgagacggagtctcgctatcgcccaggctggagtgcagtggcacgatctcggctcactgcaagctctgccccctggggttcacgccattctcctgcctcagcctcccgcgtagctgggactacaggcgcccgccaccttgccaggctaattttttgtatttttagtagagacggggtttcaccgtgtaagccaggatggtctcgatctcctgacctcgtgatccgcccgcctcggcctcccaaagtgctgggattacaggcgtgagccaccgcgcccggtcaacagacctgtttttatacagcttgtgtatgtgtaactgatttgatgacaacgaacaccaattttgaaccactattaagcaaaatgttacttccccaaaacaaataaccatctttctcattagtataccatatgatttaaaaaagcactcaatattatatttttaatgttattaatgcatactatgtagaaatttattctttcttttgatgtaataatctacataaatatctttaattttgcatcttggactgcaaagtatgagaattcattatctggcctttacaggaaaagtttgccaatcccagtgccagtgtatcacactgctctcgaaggatcatgaaatatttacattgctaatttagctgatacaacatctttaggcctttatcttctcttccttcatctcaccatctatttaactatcttattaatccaccttggttagagaaccctcaaggataatgtttttatagtgtctaacgatttctttgttctaaatctgaacgagaaactctgtgtctactatttggtctagaaaaaccataagcaacctctctgaactgatgttacatataacatgaagattgtgtatatcaccttagagccatgcaactaagaacaacatgagtctggtgacacagatccaatctgaggggagctagctggacatggctgtatggtgaatttttaaaaagaaaaaaaaaaagtaagcacttagttcagttcatttctttttatcttaaatagcacaaaattatccttttgtcatttaattcacagtggtatctagaaatcagtgatggaaaagatcaattaggtcatttagctcctttccaaggttccaattttctctttcagcatattaacttttgcctgtccaaatttaagtgactaaagagatgggtttccacaacttacttgggagatatttctaaatcaaatttatctgtaccaaagcatcgttaaagactttgctattagagttatactaaattgttctctgcttaattgcatctcatttttccttcattcctcttggctactcaaagcaaactttgtttttctttgaatagatttattttagaccagctcatcctcatatattattgacaaagaatatatcattaattgtttctgttcattacatgaattgttgcttaaatatttttgttcttttgctcagaaaccacagtggaaaggaggccactttgtattaaaaataacaatatttcataggaaattctcttaaattcatcaagggatccagtggctgtgcataaccttttctagcttcaacccatcgaacatgaatgccatgtaagttgttgttatatcttcacctttcttcctgctattcatttccccatcaatgaccattttttttttattttctgaaacttcaatcacattaagcttttcttttttctgccataaaacatggctcccatacccctcattgattaagtctaactcaagatattctaaggatgctaggttcaacagcatattgttctcttcttcctgcccaattgatggatatcctgtaacacaatcttgaatccaaaaatgagctgattaaagaagtattaagaaaatccatatatatgactaagtcaatccatcagtgttttgctcagtagggtcaacttttctgtatgtagaaaataccactgccaggagatagtaatgaactacgacctctgagagtgttgcaacaggaactaacaacaaggaaacttttgctattagagcaaatagactcctaatcaacatattatcgatccttcatttttgtcaaggttattttgtgctttaaaaaatgatcctacagcaaggctttaataggaaaagtagactaatttgatttaaagagtaaatgctattaattatgaaagacagtcaataaaaagcttgttcttccaaacataaaggcaaatcttatagtgcctttgatttatggtaatgaatacaatgatgaaatattttgactagtatctcttactctcaccctaccttttgctgtttttcttgctcacacattagaaatacttaaaataatctcttccaagccatttttggaacaaaataatttttataatttagtaaatatactttttaaatagataaacctgttacacaatattttgatattatttccagaagaaatgtaacaaaaaggaaaaatttcattttatgtttaaagatatgggtaaacatttatagttgcttattataagttgatgttcaaacaccatatagtgatgagatttaaacaagaattttagcattctaaaatccagataagtaaaaaatttcagagaactaccatgtttaaatgatatattactatatgtaaaaatatgtgcaaataccaaacatgtaatattctgtattctgacatattaaatctgttaaagccatttttaggttccattaatttattattcacattattttatctgaaagaaattaagatatacattatttcacaataataaaaaacagtgaatttaagaaaaaattcttgaacatctatatataacctattggattactagtttctctaagaaaaagggttaatgctttatttccctaaaatgatctaattatatgcattgcaagttattttatgtctcacttcaataaggtaaaatttattggttataaattatacatttgaaggactgctttcaatataactttcctcattatgagtcatcaatatatgaattgtttagtcttctagactgtaattatatgactatatcactggagaatggtagggcaggttaaccttacatgttggttaggatgagatttccttctgttatgaaagggtatatttataggttaggaattaatatattttaaatatattaactgtgaatagatgcaaagtctgttacctgaaaaatttcacatttttttctaaattttactgaagatttgtttatttgatacaacaattaatttcaaggtgaaataaagtagcatatcttgtaagaaacaagaggcacagtagcctagccttgcatagtgactaaattatcaaaacttacatggaacaaatagtttgggccattcatttaattactaacagattatattttctacaaaaagaaagctgtgttggcttaccatcagggactccattaattttagattcatatcagtctttgttagaccttacatactgagatttaatgcaaagatgatactcaagttcacctcaaagctgaaaactccacatctgtgtggccatggaccaaaaggctgttttgagcttggatttgttgatgggcttcttcaaaaagcatgatattcaacaaccttaatgacatgtaggttaaagcagatggcatatttaaacagaaccagtatttatttttaaaattgctataagcagtatgttttaaagtgctctggacacatttcacaccagggtgacaatatgcttcaatccacaccaagctctcttttagctaaagctgccatgctatgtgactatctactgagtttatagagtaataaaactctgaagactgaagccagatctctgaataaaagaggcagaatagttgctgtagtctctgtatcttactaattcagaggaagacgaatttctaactttgaataaggttgagaagatggctacgatttcatttccatggtttttattacaaaaattatgttatatggaaatattgaagagattaaattattccggtcaataagtttttcaagctttctgggagagagagagagagagaaatttacatacagaagaaattgcggggcatgaaaatctgctaagggttacatgttttctcgcaattttacataggtagacaggacatgatctaaatgttcttgaagatagaaaattagattattagtatgaataattgtgttgtactatatgaagagctaaagttacaaataccagtttcactagtacaagaccgggcaggggataagaattgtgagtgcgctgacctgtgggagtttgccgttctctgtttaagcgtagtggttggcctactgttaacatgtggactattttaggagaatagaagtactagtgcatatttgcacctttccctttttccatagtccagttgttagaaatattctgtaagtatattctcaggttctactgtggaaagtgagttcttttcttctttactccttttaagatagtaaagatcacctctctgagagtctagaactgctgtgtccttctagtcaaaaagttgctttgttcattgcgtttcttcattgctcattttctttagccttacagagtctctttaccacttctatcactatgtgtgacctgcatgttcaccaccagggtccagtggacacttctttgtcatatatttctccttttgattacttatttttcacttttgtttggttacgttttgtttcatgttgcttctcttgtacttcttagctttcatgcaaaaaaaagtggattgtgcttgttaggtaatttaagcatttttcattatgaatgctttcttatgtcaagtatagtatttgggttttctccttttagataaattaattgttcccgggtgctcaacaattcggctttattttcaaggaactgggagtcttctcttttgtttgttatttcaaaatgaatagtggtacaaaacagtggtgcaaaaaatagtgttgcaaaaaatctgatttcagatggccacaattttactgaaatatctgaacactcagcatcaatataaacattggaatcacttcaaaggatgttttacgcattggagaaatgcaagatagataaatgctcacctattgcaactatctaaatatctactttgatctcatcctcttgaatgatttcgatcaatggtaatgactgggtgaagagaataaagataggaaaaatgaagaaatgccaagttttacagtagccattgtgaaacattatgttaaaccacatttaccaataaataaatggtcttctatgtttccttgagctgaggccttgagactgtccttgtgaatacaaaatgaaaattagaaaaacagacactttataatgaacatcagtaggatctgtatatggtactaaaggcataattcattcaaaaggctgagcaactgacaatcaatgctttgagcacaaattcacattatgattttgacaaattcacactatcattttcaaaagaaatagcgaggcaaagctataaaattcttttataaaaaagaaaacttactgggatgtgtgaaggcaaaatcttggactctgtttttattatcattttgctcttccaaaatgagcaaatcatctacagaagtaaaagatttagtagtaactttattctgatgagctagaatgagagtagagccagaatagagattagaagctcatcaaggggatggaatcagagtgaacagttgttggcatttgttatctggagtcatctatgaagtaatatgagctcaggatgctaacacatggtctatgactaaaaaaaaaaagttgcagaaacaagagggaggcaagatattgacttgcagaaggttatgattttgaaattcattaaggttttcaggttggttgtgggcccagactaatgcttaggaaagatctaggggctgctcgaatgcaaccccaacaagttatgtgcctgtaaaatttgcagatctgaatatctcacatttacaacccgcagacgtgaagagaaagtatagtgaaattagtaagagatttggactcaagagatatgagttcaggagtttcctcggcgacttagaaaacatatgtatccgagttgaatttttaacttctccaacgctcattttctgattggcaaaatggcaataccactattaccaccatcattactactactagaataaaagtggtctaaagctattgagaatatatcaaaaatatatttgaaagcatttggtacagaaaacaaaatgttagtattcattattataaatatataataatggttaaatagccacaactttttgtatatggagctatttatgtgagaaaaataacttaccatatttgagttttcagttattttataatcaatagctccagttaatgccctaaaacctaaatattagtgagacagaagtatgtaacttgtttgatattagttaaatttagaaaaattatattttattaataacaatacttacaaagccattcatcctgaaacaatagtacctataatacaaataacccttaactaattttataactaagtgctaagattaaaggaaaaaaatgtgaattgattactatgtatagtgactgtcctatatatttacttgtataaaaaagcaagttttgattttagcctgagataaaagaaaacttagagttgatagtactttaattgagaaagactatgggatgacatccaaattatgtgtttctagaatggcaatgaaaatctacttcaacagggtgttctttgaaaaagtcattcctcttgaagttctcaaaaagagacagaatagggaacagactattctgaagcctttgaatctaacaaaatgacaaaatgaaagttttttttaaacagtcttcatagactgccagatttttctcttttgatagaagagatacacgaaggacaatattaacaagaaatttagaatattacaaaaaacaccataaattttgacgataagaatattttcaaattattttaaaagaagttctaaagtatttaacagactatccataaaaaagcatttgtatgctgaagtgcgtgtaaaaatagttactaaaaatccattttgaagcatcatataaatctcttcaattaaattgcaaatcaaagaggaaaacaccctttatggtctcctttagagtaaggaccatgatttcatttccttgtgactctcagtaatgccaaacataatgcatgttcagtaaatagtcagaataacccacagacttccttacattatgtttaataatttgtgactcctagagaagttaagcagtgattcctcagagaaatcactgagctaatccaataaaaattcgagtatttcaggtctcttctgctgtttctacactagccaagtacaagtatatactctggcatttggacatatacttgtgcctctacagaaagcaccatattctccagagatctggcaagtaacagacttcatcttgccagtgtagaaatagcattagagcaagactaattgctggaaagcctgttcagaaagatttgtcattcaggatggtaaaaataatcctgcttttcagcgtacattcaaacttttttttatttccagtatttaatggagatcaaaacattaccatttccacaagtgaatgcgttttatgtaatgcagctatttcctttgatttgagttcaagcagaaaggctaaaatgaaaaaaaaaattctgtctagacgtatcatgtttgtttcttgtgtgagatgaaatttattaatcctgaaatgtggcttaaggacatatttatatgtgttataagtatcttattgaaaaacagaaatgccaagagggagagacctcttagatatacccttgaaaacatagtcaagtttaagcaggtcacattcagtggggggtccagagatttatattcagggaatctaccgagctatccttgactgcctccccactcaatttgctgtcctgtactagatatgttgtcttgttgactacaaaatcaccaccaaatatgtctgcttatagtagcagcagccaacaccttgcatgactttattaacctgattctgccagtgacaacatctctaataaaatccaatgtctctgattattttaacttttggctcaaggtttccacttttaaaagaatattacctactagattttcaatcataatccaaaatgtcttccattgtgcatggccaaattgccatagtcttatctaaacagttcagatcaagccaatttcttaactctcaacctttaatagtaatgtgaacatagctgttggatttctagcaccttgttcccttatctaccatctcataagcctgagaaagcatatctgtgatttgtaacacaagagagccaacataaccacagtaaataaaagagaaacatgttatgatgttaagccagtgcactgcttggcatgcattaagttcactgtagctgaaaaaataactgtgaggctctatatcccattaacactgtgttaattattgtcattgtctcatcaatgttttgtttatgacagctctggctgacaggaatagtgggatgttctgtcaaggccatcacctgatgagattttattggcaaaagatctttcttccctttactatgttaggggtatcagtgcttcattaactctaaacataatcgcttgcaataggcccagtttttaaatgtttcaaataattgatataatagtccctttccagcattatagttaaccaattcaccctctaaaaatgagagacatccctcaatctctctcaactcaaaagaccactcaatggcagtcaaatatgaaaggaaaatactgtctcactggggaagactttttaatacggataggatgttttattcctttatgtatgatacctgtgaataaagaaagcctccatagaggaggaaatctatctcaagaaaaaaataaaacacaataatttgtacacacacacacacacacacacacccgctattcagctatgatgaatcattgccctctcccttttaaatcttgctcaatgagagggctgtggggtactacagattcttgggcaggggctaataattaccattctctttttaattatttatttctatatatagaaatagattatatgagatagatctatttcatttcatatatgacactcaatccttattttttaaaagaaagaaggaagattgcatcattcttaccattaaactgtcttatcacagcttagctatttctgtaagtgaaaatatttcaagctaaatgaaagttccctgcaatttcaaattcacagaataattctaatttaatgataaagatgatactcctacccatatcaatgcctaattttaattccaggaacatagtttcttactaacattgcttttgcttttttttccttattgactgctaatacaattctttatgacactgggtgtgcgctctagtctacaatttaggaattgcatattttaaaaatgactcagtttcctcacttatgtcattagagtcaaatttgctactctgtttaacctgcaatactgttatgacaatatgaaatttatgagtatgacagtatgtaaaaatagctatcaaaatgtgaaaagttattatctatagcactgacctgaaccataagtaggtactataagagtgatcattaattttatgtgtcaatttggtaagggtatgatacccagtttggccacataccagtctagatgttgctgtgaagatgttttatagatatgattaacatgtaaatcagtagattttgaataaagcagataatcctccctaacataggcgggccttcatctaatcaggtgaaagccttaagaaaagagatcaaaggctccagactgtaacctgaaaattctgtctgagttcctagcctttggactatgcactgcaacatcaattcttagaggaatttctagccagctgtcttgccctgcagttttcggacatttcagctccacaatagcatgatccaattccttaaaataaaccttgccttctttctctctctgtgtatcattctcaaccccatctatctgtatatgtatatacatacatagatacacacacattctattggttctgcttctctggagaatactaatacagtgtttgttagaagaaattacatatatatacatacccctcccataaattgaacacagactctctcttttaatttaaaaaaaaaagcctgatattctggaacaggatgttctctctgtatcagaatcagtttctgctcctagacagcagtcaagttctgccagtagataccagcccctccttcctctagcttatacaggcatgagagtaattaatcctcatgcttattggagtttagtttggctttggcacagtatgctttccctagcaaaccataattgattctgaataattgatcagcaacgaacattcaattttctttatcttctcttcctctcattctcctatgatatatgttttctttggggaaccattttccattttaaaaaaaaccccaaatgcaaggccttttagtgatcaaatcaattcatgctgctttctgccaattcgcatcaactccaatgcaactcctgttggagaactcttagggaaccctaattagtgtcccattgtatccattagttttcaataaggaagtaaacttcttatgtaaaaacctcggaaactatttacatgtgactgctttgccatttatcaaccaccacactagcttgcttttttcaaaaatcctttgatgaggactgttattgaaaccactaaaccctacatgagtcatggaatctggctagacaaagacacctaaaatcagaacctgtgatactcatctaagctttgttaattcacctaaggatgatgtccctcacttttctcttatgtaaaagtaagattataatgataccccacttaaataattattataattccttaggcaccagaataaaacctcttagcaaaacagaagtaaaaagttctttgaggaaagtagtcttcaaaaagtcaaggcattttatcacatcaaagagaagtgggtcactttcaggccaaaggcatgcttagtgtaaggtgcaaaattaagcttacttatttagtgaggttggatatctactttcttctaataatcaaacatagatggatactagatgaaaagtaacagaatgtgagaaactgttggatgctgatattttgagatgaatcatacatatgtctcggatatccccatttaacctcctattcaatttagatgcaatgcccttttatttctttcaacctctgaaacaagaaatgttatcatgaccttttttttattgaatattatgctgttacatacacacctttccaactctcgtgggagtcaaatgcttagaagaacaaatctacaagtggactttctctcattgtccattctacccaacagcaaattagatgcacactcaactgcctaccctgctatacactgttccttaaaacaaattataactcagcatcccatttaatccagttgcatgaaattaacatttaccgagtagccactctgtgccagaatctaagcctaattatggaaatagagctgcagcctcgttttgaaacaaaacttcccaaggccatggtctctagtcactttctgcatcacctcatcttgcttctcactcaatccctcccttcagtcccctcctctataccagaagtgttcttttctgctctgcttgtcttactgggccttcaccactgtgtcttcttgaattgctcctcctgctcatgtctgggaacctacactctctgcttttccttgtctttcgttggctgctcttcttctacttccttagtcactcccacttctcacctcagccattaaacactaatgaaacccaagcttcagaccagtgctgtgtccccatcctctccctggttaatctctgggtaatctcatatagtgctactgctgaaagcatcacatagaacttgatcatttccagatttatatctaaaatttcaaactccaataggatactagattccaccatttagagctcatatttaatatatctaaattgaaattcttgatttccacatttcaaattattctgcctcaagtttctcaagactagaaattgtgtacagtgttgcatatgtggataactgagacataatctagtcaacagaagaatgggtaatattcttctacataaccttgtcagtatcattctcatgattttttaaaaaaataaattacagtaaagagtatcagctggggaatcacaagaacctgctttttaaatacagaatctaccatgttattagctttttaataagttacttaatcttatgacttctgaaataattcatgacaagctacttaatctctataaatgtcagttccctcaactgttaaatttggataataatagccattatgaaatcagcttgtagtaagaattaaatgagataggcttcttaaaggatataatcagattttatgcattcattttttcttttactcatttaagaaatctgtataatgaatctaacatgtttcattctaggtgttgaggatgcagaaacaatcaagacagacaaggttctagccacccttgagctataaccaagttggagaaaaaagtcagcatgcaagtaaacaataatcattcaagctatataggttgtgcctcatgaaacaaaaggactttgtatgtgagagagtaatggaaaccaggcacagcttttaagagatgatgtctagaatgggacctaaagaagaaggagctctccatgcaaaaatataagaaaagcccattctaagcgagagacatcaggaaggacaaaggaaccgaggcaggaaagagtttggtgtcttttaggaatagatgagaatccaatcttgggctaatgaagcaacacaagattcgcaacagcagggagttgctactatctttagcttgaaggagaaaaaggaggaggttgtattaccagagcccaggggtggagtgacccagcataacatagaatcttagttggtatattcaagagaagttggatccaaagaagagatacagccattattagagatgctgccccagagggagaaggagagataccttgaaaatttcccttaatccctccattcgttatatcaccaatgacttccagtgactgaaccaaatcagatgccagatgacacaatagcctagcaaatgcagtctaagaattcaatctccaacacacccagtagaaagagcaaagggtaagaaattgacttgagagcaagttggctcagaacagtagacccttaaattcattaagggtcaactactttaatactttgggaaaataatcccactatgcagggaaagaggatgaattttaaaatgtcatattttaggtatataaagaaaaatcctgcctgaccctgatataaagaaatgaagatattagaaaaaagtgttggctctacatgtccaggtactactgatcacgacagcacttacaggctctaaatggttaacttcctgaaaagtggctgttatatggaaaaccataaaacaatcattggtgatccttgtttctatttaaaaaaacatgctcttaggttcaagtagactgacccactttaggactatctatccctagggatcttgtaaaatgcagagaatgagaaaaacctttagaagatgctaaactctccgcttttaagctaactagcatgttgaacaatttatttgtacaatatgagatatgaccatattgcatctcatcttatggaattactcaagttatatacaattttctcaagtgctattgctagtctggatgtaggagtgaagagaataaattgagggcttgatctatgtttggggttttcagagaagacatagaaatgaaagaagaacagattggttgagaatataatcaagtgattatgggttctgtattgagcagataatttagtccaagaagatgcttatagttatgaaagaaaattcaggatcaagtacatgaggtctatagaaggtcaaacagtagttaagaaggagtgaagaagtgtgagagctaaaggatgtaaagtagaagtcagaaagtgagggcaatgaggcattctagtgcatgaatgtgacagggagcagctgaagagaatggaagtgatagttctagttcaacggttccaggaactgccatgttagggagttagaaagttgcccacatggatttgaaatttgtccttaatttattcatcaaatgtagttagtgctattatgtctattgttcaacgttgctgagtaacaaacaacctcaaaaatcctatcggcttccaataacattgtgtctcgtgcttatcagactgtggtttgactattttcagttgatctaggctggaccatgttgctccacggtgtgagactggagaactttgctccaggatttcagtcttttctatgtgtgtttattttagagggcaggctgatggagaagaagctacctgggtatgctcttcttattgagagtgacagtacaggaggcaaaagcctaaccacacaagcaaattaaaacctcaactcacttcatagctgctaaaatttcgttggccaaaacaattcatgttttattaaaataaactgaaaactgaaattaataagaggtttttcttttctaatgagttgtattataaaatcatacggcaaaatctttggttaagacagagtaaatatttcaaatgaagatgcaataagaatgaagacaaatgctgtaaatcatgtgcttcagtggactttgagactcttggcaagtgaatggaagtcaacagagatcagcaacaagagagatagaatagacagaactagggactaatgttcaaaaaaaaccatgatcctctccatgcccctacacagaagaccttagaagaataacagtctggatagggcataaggcagtgaaaaacagaaactaccctcccccaatcctcacaaaccataaatagcaggttgtgggggcatactgataattactagtcattagaagctaactgtggaacacacactgtaagaagacaaaacatattttatcaaacacagttatgaagaaaaaacatggtggctcctgacaaagtaggcacatccctctttcacggtttaatgatcaattactcagttgaagttttggtctctgaggatatcagagtaagtgtgattgattgggattttatagaacttgtcattaataaaccctaggtgttggaggcaggaaaaacgcccatagcctggttaattatcatggaagtacttcggatttttgtcttggagggagtaagaacagaataaggacatttctgaaatcaataagcaattgtttatgtgaccggtatggttctagcaatatggggaatacagaaggcttgtaagacaaagcaatcattttcacagggtaaaattaaccacaatattaatgctacctgattgtaggctgaactggaaaagtctgaataatttatatattgaggtgcaggcaaaatgccattggaggatacatttaacaaccttccaaatacatagaacaattgccatttctaagttatgttataatcctattcttctagctcactgattcttctaaatttcaaatatagtattttaaatttcatatttttggttctttacttgataatgaatccaagctttaaaaacaagctaaaaaatgagtaaatacagttggcccttgaacaacatgaggttgaactgcatgggtctacttgtacgtggattttttttcaacaaatatattgtaaaacttattgaagatttgggacaatttgaaaaaactcacagatgagccctataacctagaaatatggaaaaacatgaagaaaaagttagatatgtcatgagcgcataaaagatatgtagatgctagtttagtttatcatttactaccataaagtatacatacatttattattaaaagtgaaaatgtattgaaacatacacacacgaacacttgcaaacaatacatggcaccatttgcagctgagagaaatgtaaacaaacataaagatccagtagcaaatcggacttgcataaaattaactgtagtacataaggtactactgaaataattttgtcactatctcttattgccattgtggtgggctcaagtgttgtgagtatctgcttaaaactccacgtgatgctaatcatcccgagggagcagttcctttctctagtaaattccgtagcacagtaaaaagccatcattctcagtccttgtgtacttttcatcgtgtttagcgcaataccataaaccttgaataatatcatgagacccacatgaaatgctactaaggatgcttgatgtgttcctgagaagcagaaaaatgtcacgacattaaagaaaaagttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgctgtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaaaaaaaaaagttgaattgtttgatatgtaccgtagattgaagtctgcagttgtgtttgtccccatttcagacaaaaacgattcatcttataaacagacaagtactgtaaatgtattttctcctccttatgattttcttaataacactatcttttctctagcttaccttgttgtaagaaaacagtgtagtagtacacacaacatacaaaatatgtgtaaatcaactgtttatgttatcagtaaggcttctacttaacaacaggctattaacagttaaatttgggagggattcaaaagttaaagatagatttttgactgtgtaggaagttggtatccctaactcttgcaatgttgaagggtcaactataagccaaaacactctgataccacaactaacaaaatctgtattcacactcaaatgtctcaggtattcttccatcaatttttctgaccttttaattacactaaatatatatatatacacatatatatacatatacatgcacacatgtatatatatactctttttataatcttccttcagataagcttaacacattttaaaattttaatatagttgtatatttttataaagtctggttctgtgtaactttctattcatttttctccaaattcatctcatgtgtatattcattctatttctaaaccttttgctattcctatctctaagacatttttattcagcaagacacatctaaaatagattttatctgcattcacttatataaccaaacgtatttatatttccaagcacatttctttcaagaattatttaacatttatccattgttaatatgttttcaaatgtcaaatcttgtatatgacaaaaggtatgactgaataaatctggctacataaaaacgttaaaatgactgtaacactaaaagtacacatatatgtgcacatacgtatcccacaaataaaattaaaagaaatttgacaaaatgagtaaatagttaccacatctgagctacataaatatctttaagataaaaagagctctgaggaatcaatgatattttaaaaattgtatcaaatcaaaatgataaaagataagactagataacccacagaaaaatgaaaatgtgttgaatttctattgaaatataaatatatacaattttattaaagtgaatgcctctacagatggtcccaacctatgctcgtttgacttaaaatgattgttttgactttacaatggtgtgaaggtgatacacattcaatagaaaccttacttgaagtcttgaattttgctcttctcccgggttagtgatatgcaatacccctgagatgctgcgcagtggcaggtttctgcagctcccagtcagccacaccatcgggagggtaaacaaccagtactgtagtctacagtgtatggtattcaatatattgcatgagatattcaacaccgttataaaataagctttgtgttcgatgattttcccaactgttaatgtaagtgttctgagtgcgtctaagttaggctagactaacctataatgtttggtcagttcgatgtattaagtgcactgtttatttatttgacattttgttgtagttttcaagttacaatggatttgtcaggacgtaaacccattgtaagtcaaggagcatttgtatcttctaatggccaaaatatttttctttaataagttggtaatggcccagatacgggagtaaagaactataaattaatataaaatctctggagaatgtctgacaacaaacatcaaaatatttaaagtgtattatttaacaagtcttatggtaatcagagttctgggttcaaattgttggtctaccacttggttgctatgtaatctcagtaatttattttactccatgagttttagcttaaattcctgcataataggatcataacaaccatctttcaaggtggctgtaagataaacagtataatacacacatcttaacacattttctgacaatgataactgttcttcagacaaaaacttctatcctaatagtttctcatctttctcccctacctctttcttttttttctggaaataattatagatacaaagaaagctctgtatacaaagatgttaaccaaagtatcatctctaacagtaaaatataggggcattggtttaatacattatgtcatattaatatagtagaataatatgtgaccatttaaaccatgttatagaaaaattaatgagattgtttagtaaaatgcttaagtgatattgatataccagaaaatcaagttgtataagtaataagtgttttattatcacaattttgtttacttgtgtggttatgcccttataaagggcaggtatttctgtgtatgggtcatgcatgagcatgatatgatgtatatgcatgtgtgattgtgtatgtgtatgcataggcacagagaaagaccagaagtctataaacattcacctattcagaaaaaatttgctgaattgctgctataaagcagataccatactaacttctggtgataaaaagtaagagaagacaaacacaaatttgtacagcaaacaatatattgggaagctagatgttgttagaataatctctaaaatagatttcaaattctgattgggataatgctacaaagggacaatgtgatgtggaagaatgtaacaggcacattgacttttgaaagcaggtcagaattccctgctcaagacccagttgaactgaaatctgcaaaaagtgcaagacatacatagcaaaaaggggaggaaagagagcccggggaaaggagcaaaggaatttggtgtggctttaatagatgagcctgaggctcagggagtctggaaaggcaggtgacagatcaaaccaggtttaaaatacactgttaaggagagttgaggaggtgatcgtataagaaaaatgatcagagatctgttaggaaaacatcactttaactatagactgagggagagcaaaagtcagcgaggaaggccaggcacggtggctcacgcctgtaatcccagaactttgagaagctgagggaagtggatcacctgaggtcaggagttcgagaccagcctggccaacacagcaaaaccccatctctactaaaagtacaaaaattagaaggcgtgatggtgcgtgcctgtaatcccagctactcaggaggctgagacaggagaatcgcttgaacccaggaggcagaggttgcagtgaactgagatcatgccattgcactgcagcccaggtgacagagcaagactccagctcaaaaaaaaaaaaaagtcagtgagatgaggagtaccgtgaagtcatttgagtaattcaagtgagagatgacagcagcctggactaggatggagtgaaatggaatgaagtgatggatttaggagctacttacagggcaaaactaaagtgatatagcaatggattggatatggagagtgcaacatggagaaaataataatatcaaccacacaaggacatgagaatgaaaaaaacaatacgccatttcagcatcccagatggggccaggcacagaaacagactgatgttgagtgagaagcagctgatgaagatgacatagaacttttacttgcataacaaaatggatagcattgccattcatggagatgggagatagggaacactattaattttgagggggacagtcataaattcagttttacatgtaaaaatttaaattattttcaaaatattcaagaggagatgccaatgtggtagttgggaaaatgagcctggatctcagaggagaggtctgggttgtatataaaagttacgaggttacatatgtggtcaataaagctaaaggtgaaagggcctagtaacaagtcttgaggtattccaggtaaaggagaagaagcctgaagcgggatagagtaggagatataatgtcacagaaaccaagggaaaaagggggtttcaggtatctaactgtaatacatcttgctaagaactcatttaagatgcagataacagaaatctccctgaagaaagagagatggaagtcattggcacccagggcaagagtgatgaatgtgtagacagtattggatcagacttgagctgtgaaaatagaaaatatgaaaaacatcttcagtattttggctataaagaggaggaacaacaaaggatattcaccagaaagacatgtgcaaggcaaattagtatagaatttgcttcttaatgggagagatttgagcacattaagagtagagatttgctcttggaagttaaaggctaaatccacactaagtccttttattcaatatttatgcggttttaacaaattgttgtacattttttaagtttacaagttgtgatattatacagataattcaagaaaagaaatattaaatagattacagcaaaagatgtaaagtttcaaaatatatcaataaaaatataaagtagatgaattagagggatctatataccctttacaaatgtctggagcttagaaggtgaacaatcagtgtgagagactgggatagaacaagttcgagataagtgagtataaagaatctagagggggtcaggaaaatttaccctccaaaagtaaaacagagcaggctctgggaagattttaaaacttgctcgagcaactaaaaatgagagttgaaaagactcctgtgatagtaagaaggttatttcaatattatatgacatacaaattgttttggagatggcatagtgtggtacagctgcagaacagcccttccctagaagccaggcaccgggtttggttttgtctgtgtcaataataaaaggcagtagcttggagaagtcatttaattaatcagagctttagtttcttaacctgtgtatttaaagagtttccctacattttctgtaagtttcttacaacattaaaattctttgtctctgtaactaacagaataggtatgctgtaagaaaaaaatatatacattgaggtaaacttaagtgtctctagagcataacattatcaaactttttttgtaggtcctgtgtaagtgagaataaaagctccacacagtccttgacttcattctaaataggttgacacgggtgtgaaatgacattctccagtcttagggatgtgtgaagggcacttaacatttctgacaagctgagtcatttgacattattccctgtgtaacttatccattaaaattttatctgttgtgaacataatttttaacaactacataaaatttaaatactctgaagaaagcacctagtcatttcaagactttctgatgtgatctatgttgaaacaaacaaacaaaaaataaaaaaaaaccctcctatagagtctcaccagagtacaggtttaaaagttaaaatatgtatttctaaaagtaaatacattatataagcatatgaaataatgaatatataatacatattatataaagtgattacatataaatatatttctattcctttttggaatttgactattttctggtgaatattaagattagcttagttttatgtatcaaattaatgattaacattgagtcaaatgacattcatatatatacatatttttaaattttagtattattatactttaaaagctttagtgtacatgtgcacaacgtgcaggtttgttacatatgtatacatgtgccatgttggtgtgctgcacccattaactcgtcatttagcattaggtatatctcctaatgctatccctccccactccccccaccccacaacaggccccagtgtgtgatgttccccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattattggacatttgggttggttccaagtctttgctatggtgaatggtgctgcaataaacctacatgtgcatgtgtctttatagcagcatgatttataatcctttgggtatatacccagtaatgggatggctgggtcaaatgatatttctagttctagatccctgaggaatcgccacactgacttccacaatggttgaactagtttacagtcccacctacagtgtaaaagtgttcctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatatacttcgcccactttttgatggggttgtttgtttttttcttgtaaatttgtttgagttcattgtagattctggatattagccctttgtcagatgagtaggtggcaaacattttctcccattctgtaggttgcatatatttttatatagggtttagcttttgatgtcaatatatttaagaaaaatttctatgtttttttcagttatgtttcatagaatcaggataacttctgaaattttggaaggtaagaggatgtccctcccactcttactcattgctaagaactttgtaaaatgtatgctgtttaaaaacatatatacccttcaaattgatttatattatgggttatgaccaaaatcttacctttggcctcaagtcctggtacggtttggctgcatccccacccaaatctcatcttgaattgtagctcccataattcccacgtggtgtgggagggacccagtgggaggtaattgaatcatgggggtggtttcccccatactgttctcatggtagtaaataagtctcacgagatctgattgttttttaaggggaaacacctttcacttggctctcattctttcttgtgtgctgccacgtaaggccttcccagccccgtggaactgtgagtccattaaacctctttttctttataaattaccaagtctcgggtatgtctttatcagcagtgtgaaaacggactaatacaagtccctttttactgggtttaaattagttagtttctacatgcacaggtaattttactcaacgctccctttgtctggcaatccattcgaaaactttttcgaattgtaaccattgccttcaatgaacaagattgtcgtctgctccccaggcatcactgaccgggcaatttcttccttagtgtaagcaatccaacaatgaaatattctcacagttactgtacatgttcttgattataaagatacacatatttaatggaaagaactaggaccataggaacagatttggtattttattgtttctaataaattaacttgtgaccttcagaacgacacttaagttctctgcaccctgctggtttccataatgattaggtgttttccaagattacatttcctctaaagttttaggcttctacatttttaaatatattataattatgattaatttcacaatttcaaagatttagtgtaaacttgttctgagattgttatatgcagatgctgtattagaacaaaataaaaactgtgaaataactagcaactttaatgttcacatataagacttcaagaaatataacaaaaagtggagttatcctggctcagtgaactaagctataaaatttttgaatggtaagagctgttagaattatgaggtatccactaattcagaatattaaatttgagatatactttatgaataattttcttttttatctcaactgggaaaaattattcttgaacctcaacagagaagtttgataaatgacatttaaaatgattaaaaatcattcacccaatttaagaaactccctaaataataatctgcagctcaattttggttaagtttttgcatggacatgtgaaaattggaaagtaaaataaattgcttctggtgattttttacttttttttttaacttgtacagtatacatttatttaactatgactgctagtaaataattaaatataaacctctgtaaagctttctgctgtaatattttggatgagaaggatagtttaaacagcaaggtcttcaggatatttgagggtttataccttgcagtaaaaaaggagagaaaataaaacaaaaaacttttacctagtttggatggaaaccttctagaattcattatacactaatttgcttctttcaaaaaatgtcagagttataaacataagtaaacttgagtttgctgatgcctggtcatcatttgcttattaataaatgcagctttctgtatctcactggtgtttgtaggactctgtacatctctatattgctgcattacacagcctctgattataatgcttctagagttagagtttttaaaaatatatattttatatataaatttatatttttatattttatattttataaatataaatataaaaaattttatatttataaatgtatatattatatatgtacatatattttatatatgtgtgtatatattatatatgtatatatattttatatatgtgtgtatatatacatatatgtatgtatatatgtatgtatatatgtatatatatacacacacatatattcacatatatatgtgtgtgtgtatatatatatatatatatatacacacacacatatattcatgtgagtatacatatttcctttatggcagagtgtaaaatagcaattccttctaattataataatacagcatacaatacaaagtgaaccatagtgtctcctacaaagtaactatcctacaaatgttagctgtcattagtactattaaatagctattgaaaccctgatggtttgtatcagtccatttatttctttttaacaggctatcattctgatgcaaacataaataacaaacaatcttggactatgttgaaaaatgggttaggcttgcagtcaaaacatctaggtttaatcctggatatgttgcttcatagctaggttaatttcattagcattgttacccttaagcttgttgtcttagattttaaaagcaggacaataatggttatcttgcagattcgttatgagtagcagtttaaaaatagatgtgacaaaaaggtgagaaattcattatcacaaaactgtcacacagaaggcattcagtaagggttaactgaatctgaaatcaggaaataaggttgcttctaaaatataaacatttataaacattcacaatattccaggccataggttctgcatagcacattagggagacaagactcactattaagaaacctgtcattgaatatgattattgtgattgagagagcagagaaaggagaataatagaatccttactctgggacagcggaatgtttgtcctattaaaaaaattctttacacaattataatttattttattcaaaaaataaattcactgtaattacgtatgaagaaaataaacctctgcaaaattatctatactatgggaaaaagaaaaggagtgagaaagtaattgagtgaattcaactgttaatatgatatataacacatttttaaatttagagtagaaactataaataaagctatgctgtaatcaaaattgtactaggaaatacacatgtaaagatacttctgaatatttctttgtccaattctcagtcaactgtaaaactgctgagttttggagatataaactttgcaaaactcagatcattactccttttgggcttttagttacaattaaggaaattatgattatctatttgtttatatttgctgtgtggcaaaagacaatatgaaaaatgttacttagtgagggtttggtgatcgttaccagcttccacattatccttaaagttgtgttgaaatgattgaagataaatgcacttaatttgaaaaaaaaaaaaatgttggactggaactgatagtgttccaggaaagttgaaagaaatcatgagcaggaaacagtgaacaatcttacgagacatagagacatacaggctctcagttagctctgaatggcctttacaatcaagatataaactatgtgacaaatgagtgtaaaataccaaagcactggcttgtttcatgaagataagaacagtctcaaagtccttgtgttccatatggtccatggatttccaaagaggaatatgcttgaacagatcaaaaagcaaaatagacattgtgtctggctggtatttgggacatggaagagcgacatctaatttcttaaataatgtcaacttatactgctgtgcttttattggacagatatgtgtgaggctttgaatacatccaaactgaaacttcaagaacaaacatcaatattattgattattttaactttttttagaagttctaactaaaatgcagccctgggcatagaaaactggtgtttaaaagaaatagtcttattctaaacaatatatatacattgtttatattttatataaacaaaattttttgtttatatatgtattctgtttatattttgtattataatacatttactctgtattaaagatgaattcaagtggtaatattttcattgtgatatggctcaaaaatatgtttacattttgtgaagttctcttgtctcattgatccttaggctcctaaagctaatctgcaagagggttttcagatttcaattttaattcatttgccaatataactgctagaaaatcacatttagagtaagttttggtaaaatatctaccttattacaaactgagcagatttgggtggggagcagtatctatcctatttatattaataaatatatttcagaatctattttttctctgtacttctgaagtgaaaaataaatcatcagagtagacttaaaagtgaaagtggctgctattgtcctaaatctatcccatttgtgatatgaactcagaagcttcagtttctttggaaattattatagacacggactactgcatgaagtttcatttaccttaaacttctaattgaagtttcacctatatgtggctgagatgctgattcagttcaattcaaatattaactaactaaatccttatctggctgatgagaaagaaagagtagcccacatgaagcaggagaatagggtctggaggcagggaagctaaggtcaattcatgctgacgtcctagaactggatcaaaaggaaaaccccacctctccatgcccaagtgacaaaggatcaaatgctactccttccacaacccccacccccttccactgcgtcacagatggaaaatggaaagtacctctgattggacgtgggccaagcgtgggccaatccttcatttgcataaggtgccaatccatttcagcctctgattggccagagtcaaacctccacttccatcctttattacatagcgtataagcaatgggaaatctttaaagggtacttaaaccccagaatattttgtaaccagggctcctgagctgcttgcttgagcccgctccaattctgtagagggtattttcaccttaataaatctatgtttctgttgccttttgtgtcaataaatctatgcttttgttgcttgttcatgcatgctgttcaaatccttgttcaatacatcaagagcctagatgactcacgatcagaaccctttatctagtaacactttacaaacatatatgctcattttaatttttaaaataactttttgaataaaataatgtatgtttataaagtgcatagtaaactgtaaactaatatgtaataaatgagttattgttgtcatccttatctttttctaatcaaagtagataatatctattctaaaacaagttattcaaatgtcttttgccctttgtcttattcaaatgtcaattgcctctagaagttttgattttaagaaaaggaaatgttttgcctttcaatctttatcaatggaaaacatttcactcagtctcaaaatgcaatttccacagatattttattgggtagagtacttttaaaaagctctaaaataagaaagtgatgataatggaaagcaatatttagtatcaactttgaataggcacaaagagcactgatgtaattagagatacttagacatgtagctaaagaaaatatacctctgggagaaaatgtaactgctgttactattttcaaacaaatatggggctcagaagtatctatttaagtgccaatattaaatatctcaccatgtttccattataaacccttcttttaggagtttataactgggccataaaaattcacttcaggcactccttagtatccaaaaaagctattacagccttctgggaaaataataagcatatttatagaaggtatatataaaaatattgatatgtttacctatttttaaaaatgcacttgtgacaactaatctcctttatcaatttgctgaatcatattaccttcttcagttccattaacctaaaaggaaaaatacaattaaatttagtctcctttcaattgtttctaaatatgattaatctggtgtcaacaaagtatcgctgtacttcagaatttgcctgctggcctctaaaaagccaaggaaggggtaataacttttaatggagtaaatacttgtttatttttctgaagttaacttttttgttgttattgttgagatttttctgttgcaaacattgtgtacagtcaaaaactctgcgaataaagaaacagagacacttataaatacatgtgtactttttgattatttctttagaatcagaaagacttaaacccatgtacattttattttggcagaagatcatgtaatttttccacaattactcacataccgcagcagaggacacaaaatcattccaggctttattaatttcaaatacccaaaactgtcttgagaagaaaatacctttatattattttatttgatagtgaagtcttaaagttctatttctctcataggttttttgtttgttttagcagttagctaaaaagtttcccaattaaaacattttagtacttaatcctatggttgtcatgcatgagactggttcattaacaaggtggaaggtagaatagtgaatagatttttcacaatataatgagcatgataataataatagtagtagtaataagaaataacaacaatacaaagaatactaacagcaaacattctttttgagtactttccacctcactggtatgcggttaagttctttacatacattattccccaattaaatctacgagatcagcgcctgttttgctagggaaactaggctgtaaggaatgaaatcactaacgcaatattatatagctaactattggcagtgctgggactcaaattacattctgaagatgaagcctgtgtttaataatcaagttctaccactctttctactttagaagaaaatcagtatgatttggttaaattagatgctctaacaagaaggaaatagctgacccaaattatagatggaaaactatacggtaagatagctggattgctagacaatagtcagcataatatcactattattaaaaattcataaatatttttgccatcctaggaactagtctttaaacttactacataccttgctattcaattgcaaaatgtaagatttaaaaaatggctcttctttaaaataaatgtcaaaaagaatggtgttatttatctttgaagttagcaatattaattacttgaaaattagtaaaattgtctgacgtttaagaggttttaaacggtctcctaactattatacttttagattttacaaaatgagtgttcaaatatcatctggtttataattaatacataaaagccagtgaatctaagtgcacgtacatttttatttaactgtgtaattactgattagtagttcataaaattggttttgatatattttgagagcctttacaataactttgcaacttttaactcatgcaaaagtgattcagtataaagttggactaaaattcagaacagaacttcttttacgaagttaacagagataattgatatttcactcaatgatgactgcattaaaatcattgacacacatttaacattcataactgctctaacccttgaatttggtatatggcaatatattgaatctaaaactcttaattgctttctcatcaatctatttctcccctggtcttttcctctttgtaaatggtaactctattcttgtagttgctcaggcccaaatctttatcatttagttgtcttctacatgtcatttaaatcaaccagtaaaactcattaatgtcaacttcaaaatatatccagaatgcagccatatttcatcactttcaacaccatcaccttagttcaaccagtattactccctacctggtcttgggcaataggttcctaactggtttcaccatttaaatccttactctctacgtcttccatgcaaaaaccaggattggtcactgttcatctagccaaatcctaccattcagtaaaaccaaatcatcatcactatctctggggtcatgtgtggcctgaacctctgctctttttctgtcctcattctccctgcccagttttgtttgtttatttatttgtttcaatcactcagctcttgctacattggtctttccttgagtacacctaatgtggatctgtccttgatgcttcgtgactattttcctccctgttcaaaatattcttcctccagatttccacctgtcccattttcttcatcttttttttttaagtctgtgctcaaataccatttagcaaaaagccttctctgaccaccctatataaaagagttaggtctatcactctctggaagcttttttatattaataataaccatcccttatattctaggcattctgctaaatgtattatatctgctatttcataatcttcaagacactactgagaggtaggttttattatttctcttaaataactgaataaaatttaaataaaacactaaaggtatggttaagcttcaaaccgggtctccggattcctcagtccttgttctccatgaactgcataatcccatttatgcttcaaaactctcccaatttaacaaatagggaatgtgaggctcaagggtttgaaataattgcccagatcacacagcaagtaagtagtagaacaggaattcaaatgtaggttgatcaaatctgatgtttactcccctgcaccacactgccttcctgtggacaaggtcatatccttattgccaattgccagccaaagatagataagatgagttcactctccattcttctgggctttatttttgcttacttactcaagtctcacataaatacatattcatcttagatctataacttggttgatgtagaaatataagaaaagtgcacatatgatatagaacattaacaatattgacattatcccagaaattatataattaagaattgaaatttatatgattttcattgatttttttcttcttttatttgctaatattctatcctctcaacaacatactgctaaactttgctttgttcaatgtccatgcttgatcattgaattaaaatccctctaaaataataagtaggacatatctcaaatatatgtatccataatataaaacatattcatttagaatctttgcaatgtaccattatactaaggccataataaaaattctcacttgtctgtatacttggtgaaagaataagatcaactgaaccatatagttgctttatatagaaatcagcctgtacatatctaattgaatttactaattgtcacaggtgaaaaaaaatgccattttcatactgaaatcaaatataatcctgacataaaggtcataaatttaaaaatttatgcaaagatacctcaagctactactggaacacctatatccaacatacagaaagaatcaatacaagcattaatctgatagtcagtattagacataaagtgactgaaatagagcttgattacaagagcaatgtctcctgctttgagaataaacatttcagttttgtctcagcatttatgtaacagcaggagagagaagacaagttatcttgtgacaacatcctgcagtatgtcattgacattatcttataattagacttgcattaaagatgattaatagtatcttctttggtgcctaatcagtgcagtctcatagcatatacaaaaatgagtattttagatcactttaagtcagtattacagcagtaaaatcgttatgttccttttccctcaaagccatctcaaacaaaataacaatattttcattcaatttttgttggtaacagtttgaaagaaaatgccacaagtatttagagtgttgaaattcaaattttatctaattaacctgaaactcctgtattttttgaatccagatttaaaccactattgtggctaccgctaatagctatatatgaattaacagaaaatgaaagatttacttctaagagaaacataacacaagctagtttcatgtgtagtcaattcaaagttttatgaattattggactcagattacctacaggcctggaagacagtggctctgtctactattggagatgctggctcattgcactgaaaatttgctatttatgtataaaggataagattggacttagaaatctgtaaattaagctaagtgatttaaagccatgcagcgtacatgtgagacacaagaatcaaacccttaagctttatttgtgaggaagtagcattcatgtgtgcttagcctaccaagggggatcagcaaatgtttgctgaatggatgcatgaatggatggagtggcttcatagcacaataaagtcatgtaccacaatagttagggggtacagctggaaataacaagtctttataaagtgaccagactaaaacagctttaatgctgtcccactgctacctatttgcctactgggatctgagtgatttgttgagaatgaagtatcctaggcaaccatgctaaaattatgagttcagaaaaggcgaactatttaacaggctagacatactgatggaagctattgtggggccttcaatttaaaatttgttgaatttgtgtacttagttccactgactctgtattattaagaaattccactatgggccaagcgtggcagctcatgcctgtaatccaagcactttgggaggccaaggcaggtggatcacttgaggtcaggggtttgagaccagcctggccaacatgaggaaaccccatctctactaaaaaaaaaatacaaacattagccaggcacggtggagtgtgcctgtaatcccagctacttaagaggctgaggcatgaaaatcacctgaacccaggagacggaggttacagtgagccaagatagtgtcactgcactccagcctgggtgacagagtgaaacactctcaaaaaatacaagggggaacacacactggggcctgtcagggagtggggggtgggagagcatcaggataaatagctaatgcatatggggcttaatacctaggtaataggttgataggagcagcaaaccaccatggcacatgtttacgtatgtaacaaacctgtacgtcctgaacaggggcaaaatgccaccagtcattttgctaaaatgcaacaagagtcacctatgcttcacttcccaacaagttcttcatctccatcagcctcagcctcaatttcattgcccatatcactatcagcagtttggtcaaagccattcaacaagtctctagggagttccaaattgtctcacattttcctgtcttcttctgagccctccaaaccgttccaacctctgcccagttacccagttccaaagttgcttccacatttttgggtatcttttcagcagtgacccactctactggtactaatttactgtattagtccattttcacgctgctgatagagacatatctgagacagggtgatttacaaaagaaagagttttctttacagttccacatggctggggaggactcacaatcatggcagaaggtgaaaggcacatctcacatggtggcagacaagagaagagagcttgtgcggggaaattcccgtttttaaaaccatcagatcttgtgagacttattcactatcatgagaacagcacaggaaagaactgcccccatgattcagttacctcccaccaggtctctcccacaacatgtgggaattcaaggtgagatttgggtggggacacaaccataccacaatgttttagaatacatttggccctataaaactgtagattcaagtctacaataatttctcaaaagttttcttaaattatatctttctctatgttttaaattttcctgtttatacagtttgtttctaccagcacatcaattttctattgatggttcatttatttttcaatattttcaatattgaaaattttattgaatattcaataaaaaatattctgattctggcaatcagaaataataggcaattatttaatgcctattgtatgctagacagtgttctatactttgtttcataactttttctgtgatatatatatataattttctttacaatcatcttccaatattctttcattttgactcattttgcttactttatcagttctgttctctgagccccttattactctcatcagtgactttttactgcttctattttgactttcacttctgtaactgctttatatttacctttaacatcttccttagtctctcctggtttgggttttatctttgtgtcactatacattctgaggtattgaaatactgatttgttgttttgcatcgaggttgtttgggggtatgaggaagtgagaggttcataaaataaaacagtgtgatttccttctgctcataccaatatttttcttgttgcttttctcagcctgctccttcctccctttctttttctctttttgttttcccacattattgtatagagcctatacttgttcattttcttcattattgctcttaaatgaagtgagtacaacaaaaattgggactgttaagtgcagagtatcagaggtttcctctaattaatgggaagtttcttaggattaaaaataggtgcacatgtgattgtgtaagtgtgtatgtttttgcattacattgtatacccctctccctttaattttgccactcactgattcagctaatggcaagatctgagaacaaaaaaacccatgctcattcagatgctaggaaaacaggctgaaaagagcagagaacattccccaagcccctattttactaaggactctttgtaatataaaaaatataaattttttatctgaacaaatgaccattttatatttctatataaaagttggtggtttaataatacaggactagaataatgtagatttttaattttcatagaaattaaactctgtagccaaaggccctcagagattactaaacacagaaggcatattgaaaacagaagattctattttgacagaaggattagacatatttttgttactgagaaaatactatttattttcatagactgaatgtttgagtccccccaaaatgttaaaatcctaatctcccgtgtgatggtgttaggaaatgtggcctttaggagataattaggtcttgaggatggagccctcatgatgggattagtggtgccataagaagagaggagataacttgctctctctttctctttttttctaccttgtgaggatacaaggagaagatgtacatctgtgaattagaaaaagggtcctcaccagaaccaaatgtgcagacatcatgatcttggacttccaagcctccagaactgtgagtaataaatgtttgttgtttaagccactcaacctatggaaatttaatacagcactctgagctaagacattcatgatcacttttaggtgcctttagttctggtagtcacatggaagatatatctgaagagtctgatctcctcttcactctgcgccctttccactttatagtggatgcacatgaaaatgtattttgggggccaggcacggtggttcatgcctgtaatcccagcactttgagaggccaaggtgggcagatcacgaggtcaggagttcaagaccagcctggccaacatggcaaaaccctgtctctactaaaaatacaaaaattagctgggcatggtggtgtgtgcctgtaatcccagctactcggaagcctgaggcaggagaattgcttgaaccaggacccggaaggcggaggttgtagtgagctgagatcaggccactggactccagcctgggctacagagtgagactctgtccccccccccaaaaaaaaggcaaaatgtatttcggggaaattcctgcaagcatactagtcttagcaagtattggtgtggcttcacttgggaaatgattgctttttactgattgtttgctctttctagactttttagttacattctttcacaggaaatatgtttgacttgttgttattaaagtacatagtgtttctctgtggcccgttttgggtcctagcaagtggctgatggcttccttgcactttcacacactcgtggcaacattcaaaagaaaatgaagtcagacttggaccaagatatacgcctttagatgatgctatgagatggtcttttaaaaatatttcatcaaagttctttgtcttgaaagactaacaatgcttgttagattgttaatttttgagatccatgtgacttatatctatattttcatatcattaaaatatttcactggctgttgagatataagtcacaatctgccaatttgtcattcttttcaatgacatctggatccaaaatcatgattggttaacatgtgaagttggtccattaattttatccaggaaaaagttattggaagctacatacatagttttaagatttaaaatttcaaatttctatgactaataaactacagaatccctcatgccacatctctaacacattgattccgtaaatgtttcttaaattatgttcagtgctaagatgccaataaagtttcattttagatgaatacaatataaattgatttattagttgaatatttgttgtatatttgggccaactgtccaagtgaatttattcagatatccacattttatatataactactttcacatttctgagtaatttcattggcacatttttatgtgttacagaagtactttatgatttggtgaaaataatatttactttgattttcatatcgtaccatagctatctaagaatctacctttattatctaattataaccatcctgccaacaattctacctctagatttgttctattctgcatagacatatctacctagaagagcctacctcagagaggaatttccctctgaagtatcattttcctgtggcctgttttcttgccttcttgttttgatctttcaggcgatgtgactttcctggctatagttgctctcctgagtctctgacctcccaacataaaaaggcctcttctcccttgtgttgcctccgggttttctctttcattgttatgtgtgtaagccttccttctgcatgactgattgactttcttccctgatctcctgttttggaagctggatcatcatgaccacttacctgaccgctgaaccatcagccattctgcagtgtaacttttaacaccttttagggttccttaaacctcacatttttatctactgagactgtgatataactttaagcagtaatattaaaacttgtaatattcatttacaacagacattttttctgcttttttaagtgaaaagttgaatattagcaatttaattggatcaacctaatattaagtgtaaacataaactgtgctgctgaaaatgttcagaaattcaaactcctctacttcaaagctctgacaccatgtcacgaaccaaagaaacaatttagtagctcttacataatagactaagtatcatcaaacaacactgtttactttctaaaggcaatactctaggtgccttaatgaataaattttatctataaaaagtacttttaaaattatattttattgtggtaagtcattaaggagcaaattttctgacaatattttaactagttttgcacttaatccaataatcaaattaagttttatctatgttattatagaactgatacattcttgagaaagatgtatatattgattcatatgagatttttcataaaaaatatattaaagaaaaatagcccctcatatgcaataatgggaaagccacatggatttatattgtagctatggtataagagatcatgtccttattataatcttcacatctatgtttacatatgttatttataaatgtacattttgcaatgtcttgacatttgttagctgtgaaagactatgccaggtatgtttcaggggaaaatgaaagtgcttgcccagaaatataaaaacaatgttgtctcgtctcctaatatttacatttttatttctgttgataaaatagacttcagtgtaacagcatctatacagaataaattcctgatttacaaaatcttctgcaaacaattattggtttctcactgcaaagtatagaagttgctactgtcaaatcagaaatatttccctttgtaactgtctgtacttgctgttgccctatcatcgctataaagggattttttaccttgagtaagaattgagcaatttgcaaaacaggcaaaaatgaggagtagacataacccttctaagagctatgtactcaagccccatcatcactccctccgtgcaaaacaataggctgtaaacaccatccatgtctgtagcacttttccacatgtctttattctttcaggatatactcctaaattaattccagctcaaactacttttagctcttcactctgtttctcatttattatcctacttctacttcctcagatttagttctcccctctctaaatagtgactgtcagttagtcttcatggcctctggcttgaattgtatccacaaggttttctggcttgcaactactttttaaaatttatagacaggaattgatctctaagagtggatccatcaaccataatcccaaaaggagaacaatttgagatgtggtttccatgttggccttcatcctgtgccttagtttagatttctttagctttatttcagtttttattttatctcctctatttccctcatttcatgcttctctctctttcccttgtctttctttccgctatttaaatgctccagaacctttttattttaatgtcaagtaacacgctccaaaggtatcacctgggaggaatgaggaaatatgaaggcctagaaacctagggaagaaaatcaaatgcaatgaatggaaggaattgtaataaacacacatggtaagagcatggtggagtggatgctttggtgatattcccagatcccctcccttaaagactaaagtattcattcttcccagctgctgtaaatgctgacaacagacaacagctgggcaaggggagcctccttgtctgaggtcacacactctccctgggagcacgtcgtatctattgactggctagcaggaagataaaagacttggttcctttgcttcagggattactgtcaagagtcattccaattctagagctccccatgagattagctgatgcctttttttgagacttcattgcagttcaactcttctcaatccaatttcctccactgctttgcaggtattgatctcaacaaaattcttgcatgcaaatttccatatcagaatcttttatctaataaacttgaccagaaataataggctttgggggtcagagagatctgggtttgaattcaactgcacttttacttgctagctgtgttactttggggtttattttctctataggcaaaaatgggtaataagaaagcggaagtattctacggtggtgacatccttgaagttgtacaacataattccctgaaaaaaaccactacataagtgaaagattaaatcatatatttaaagcagttactgttttgcagagtagacacttaatacattttttgttccccccttttaactttggacagattgaggaaaacaagaaggaaaccaagcaaaatagtcaattaaggatctaattaagggtagagtattccttatctaaaacgtttgggactggaagtgttttggatttcacatttttttctgcctttgtaatatttgcatatatacaatgagatatcttggggatgggacccaagtctaaacatgaaatgaatttatgtcttatatacaccttacactcatagcccaaagataattttataaaatattttaatgattttgtgcatgcaacaaagtcttgactgtatttttactatgacttgtcacatgaggttaggtgtgaaaatttccacttgtggagttacatcagtgctcagaaaattttggattttggaacatttagcacttcagagtttaagattagtgatggtcaatctctttcatttttggagtataagatagttatcttagaatcaaagagatttttcagttactttaatgggatgaagacaaattaagatggacaagcaaactgtttgccactgctgagttatctttattttgacttgaacctattaaaccctttgtgttaggcagaaagtccttctctgtcccaactatgtccacgtctcaatctctacaacctataaatatgtttccctatatagtaaagtgggctttgaagatgcgattaaattttaggatttggggagggattattctgaattttccaggtgagccaaatgtaatcacaagggtcctcaaaaatgagaggcagaagagaattagagagagagatgactacaaaagaggttagagttatgcaatgtgagatgagttcagcctggcgttgctggctttgcagatagaagaaaaggagccatgctggaaaacatacaaaagtagctcctcccatagagccccagaaaggaaagcagctcattggacactttgattcttgttcagtgagacctgtgttgaatatctgacctatagaaccataagataatacatttaacaaatgtgtatgttgttttaagttactaaattttaattgatttattacagcagaaatataaaatgagtacacttttcataactcatggaaaagttatcaaccagtaggccgtgtctagcgaccaaagagcctcaaccacgtggaaagaaagggaacaagatgggaaaccagtaagagtatgacgttaatcattggaataaaatatatttggcatataccaatggttgatcgtatgtttacaatatgtttctttcacactaagcttgttttgccagtaccatctcttgaccttctaagatgcaccttctcttccccatttcctttcaattgcatccataaccagaaaagttatatttcccatcacattgagaaatagctgaaaactttctttccttatttttgcctactgctcaccttattttgcttaatattaacactctgttaattcaaactagctcttgatctggatttttatctctcaacctctacctaaattaacttttttcctactatttctccagaaataagcattgctctcacttgttttgttgtcatagtttatttgtatcacaaggaaagactataatcacaactaaacatccattgattcatcaaaatagaagaaagggaatccctgagtttttatgtgatttgaacaaaatacagagttcaggagaagaacgcagtatgtagaggactaattaaaatcacacaggctccagttcagttcctgctcctccaattggtcagtatctcatgtcaaggaaattatttaaatgtctaaatcacactttatcccctatgaaagatgggctatactgacccaacagagttatgtgagtatagtaaatgatcataaagtactctagcaagataacagataataaacttcaaataaatgttattatttttactacaagaaccattgacattaataaatattgtcctgaaaaagctcccaacattatattcaatgccatgttatctttgatggcttttgtgcccatgtccacatactcttctaatttatagtctgttcttcatgcaacaataatcaagaaaaaagtgaaattgaatagttggttttatcaacttgaaactttgtttttgaaaattatatttaaatttctattataaattatgttagaaagcaagtttattatttacaaaactatttttggaaatatgttctgagcttccaacaactgtctataacttgaattttggcacctattattgtaatattctttcctggatgtctatggcacgtagatattctaatagactatgacttagaataatatcaaagggaaattcaatagaaattatcagtctttttggcacaaaatatttcaaatggaatctaatgcctaatttttcccattgtatgtgttggcatattaacttagatactatagacttttacaattggcataaagtcttgattatgccagataaaaaaatttgagagatctgctgcataacattgtctctgtaattaaaaatactgtagtgtacatttaaaatgttgttaatacactggatctcatgttaagtgttatactacagtaaaagaaaataaatcagagaactttaaaaattaatttcccataccaaagattattgtctatttatttttaatagtattgaatgtttagctctttgaccaaatagcattattaaataaatacaggcaaatactaacttcatcaaagtcatatttaacaagactttgattgacttgccaacactatgggtgttgtttttcctctgggccatggctgagactgagaattcctgccctctctcttcgtaagcatttctgaccccctggacatttattttggtatgctgtccacttggggacaagttgctatagttgtgaccactctctggcctctttccctagaaaaagcagatcaacacccttctttccaaaatgcagcattttgtttttaacctaaattcagtaattagatatttaaatgctattagatgtaagtaaattgctttgattttttatttcactcttagtgattttccagtggttcatttgcaagaggtacacatgtttctaccacaaaactcattacagatagtctagccttagctcaaattttaagagtttgacctttgttttaattaatgaagtggcaatattaaattattaaaagtactggaaccaaaaaaagtgagaatcatcctcaaaaatattttaatgaaccccagagtaaaattagctaggtgaattattaaaaactatattatagttaaaatgctttcctagtatccattaattaacacaattaatttcacctttcttaatgaacataactccattggcatttggcattttttcctctttcttgggtttctttctgcttatttatgtgttttagcagtaaagaactgcaacctcagcaaactataaattttatttttggaacacaaaatattttcctgggagccacgacttaacgatttatggagaggtattttatttttaaatatatagaggatctgcaagaacaacaacaataagaaaaaactttatatcagtcccagaaaaagtggttctaattaaaaattaaggtagagtttattaatttagtaaccaagtccataagaatagagaacaactttttctttattcagtaatgcagaattaacattaaatctctttgataattctaaaactatccgtgcttttgtattttagttttctacacacttaccagctcattggtttctggattagaaaaataaagttaaacacaaattgaggagcagtactgactgtgcggaaaatatgctccactcttaaaagtatgctaaatatattttttaaagtttctaattaaaaattatttacttaccaaatgtgattgcacatgtcggctttatttaactgatttaatattttgattgcatacctcctaaatatgttttcaactaagataattgtgttaatttgcatcttgaaagggaatctttcaagacagagaattgtcttcaaggtaatctctggtgaattaaaaatatattttttcaacaatttatgatataatttttaaacattaattccctacttactctataacccccgaagttctccctagggttatctcgtaagcccttcttaggaaatgactataagattgtgccttagagaattctagagaaagctttttaaagacaggacttattggtctttacataactgaaaaacacgtcaaagaaatagaagctcagagttcaatattttttctttagcataggatagataaaattacaaaaattctttcattgctgcgttacagaatgacaagaataatgttatagtacataaatgacaaagccttattatctacactgctatactgaagtttgagaaattctgaagtttccaagcaagtctccccacaccacaacccccagaacaagtatctatctaaatcaaataaaaactcagggatactaggagaaattaattcaaacttgacagatttctgaccccagttgttagtgtaacactagaatagttaggattaagaaaatggggctcaagctctctgcctcgttatcaggttctatattgttactgcttcttagtgaggctgatggagtcgaattagtaggtcaagagagcaaagctagtcagttttttaacagtgctaccaagcacgtcacatttggaggactcagcacagaatccaccgaaaacattttgttaattttgtactcatgttctaaacattatttaaaaaggatcaaacacagactctctcattaaagagatattgtcaagcctgagtttgattatgtgttaactgagaacaatttactgcccaaagcccctatacagttaacacaataatttagatacaaacagaaagaaaagtgctatgaatcttgcttcctggagtgacagaggttggagcgtgggtgagatttcaatgaactacatttatgagtggccaggaactatagataacagcatagttagatgcaatattttatctcaaattagacccagacattgtgaagcaagatgtccttctagcaatcttagtaagtgttggcagcaagaataggtttcaatccaacaatacatttctaaaagaagcagataattaagtatcacctaattatcttccctatatcttttgaaaggttaacactttcatgttttaaaatcaaagtaataaggggaaaaaatgtagtgacctgaatatactccctaacctttaaatttctaagactttttttttttaacatttcaaatcctatatgtgggaaaattatattataatgggggaagcctccttttttttttcttttagttcaagttttttccaagtttcttgtatttcactggaaacaacatagccagatgaaatatctccaactaaagtgtctttacaaaacagacaaacaaaagtacattaagggggtttggatttttaaaggaggagttactttcattacacgtactaatccccaaactctcccctttacatttgacagtggcctcattcctggtattagctaatgtcatcagtgttaacttctatttcagtagagaagaaaatgtatcttctcaagatacttttaaatctttgtttaggcaaattctcaatatacagtaaaggaaatacaaatagaaatatttctaaagtatctaaagtctttgcttgaataacgatgaatagaaataatacacaaaaagacctgtgttctcttcaccccttgatgaaatgaaatgccacaaataacaagtgaagctccctgtattggcctccttacttcctctcccatcctctctcctcatagataaccactttcttcagtctggcattcatcatgtccatgaatttatgctttctttatgtatgtataggtctctaaaacataaacattagaggcacagtggctcatgcctgtaattccagcactttgggaggccgaagtggatggatcatttgaggtcaggagtttgagaccagccttgccaacatgatgaaaccccatctctactaaaagtgcaaaaaatagccaggcatggtggcaggtgcctgtaatcccagctacttgggaagctgaggcaggagaattgcttgagcctgggagacagaagtttcagtgagcctgagatcatgccactgcactccagcctggacgacagagtgagactctgtttccaaaaaaaaaaaaaaaaaaagtaatgaataaatgtggcagactgccacagttactacttgagattgtcactacaacagttactactgttactacttgagaccatcattacaagactgaatgaaggaggaggaatgcagagatgctaacaaaaaacaaaagaaactgttttcaaaaaagggtccagggaagaagaagatagctccctgcttctagtgagcaaaggcagcagccctgagcttctacagcccttcatatttgttgggtagaaagagcagggaggaggaggtaacgattggtcagctgcttgattgatcacaggttaacattatcactaacaggcttcagatttgcctaatcacaagaaacacttgtgcctgggttctgactgccctcagcattccttcttggcagcagatgcagtttgtcaatttgccaacatcctgctttcatgagaacagtttgctgtttactaatgtagcctccagtgatttactgagttgatcaggaccctcactcatgtagcctccagtgatatactgagttgatcacgactcactcatgtagcctccagtgatatactgagttgatcatgaccctcattctttcggccttcaataaataaaggtatgtatttattttgtagtctgttcttttaaaagccaaaatgtgggtctgtgagatacattcagattgataaaggtaactcaaattccttcattgtcactgctgactgatattctattgcttgaatttgctaacacagtctacttactcatccactgttgatagtacagtaggtggctccaataaattttatataagtaatgcaaataatgtttaacactcttaaacaagtatccttatacatacctacgaaggaaattgctgagtgttggcatgagcatgtctttaaatttatgtctactgacaagttgctcttcaaagtgtttacatcaatgtatatacaaatgggcattgtttaacatttgcttttgctacctgattcatgccaacacttggtatggtaagataccatttttagtattctgatagctgtgaagtatcagctcttatttttatatgatttttcctaattgaaaccagttgaatagttttccttctgtttattgagcattcatttttcttcttttagaattcttttttttcttttgacagagtcttgctctgtcgcccaggctggagtacagcggcatgatcctgcaacctccacctccagagttcaagtgattctcctacctcagactctctagcggctgggattacaggtgtgcacaaacacacccagctaattttttgtatttttagtagaggcggggtttcaccatgttggctaggctggtcttgaactgaactcaactgatctgcccatctcagcctcccgaagtgctgggattacaggcatgagccaccacgcccgacccatatcttttgcctatcagactgcagattggcttgtcttcctcttcatattcacagaagttcttttcatattccaaataataatcatttgtcaattatagaccttgaactttctcaataaagtttatctttagtctttcattttgtgtttgtttgatgcacaattatcaattttgataaagtcaaaaaattttttaactatgaaaatatttatgattttgtcttgcttaagacattattttttactctggactcataaattgttctcctatatatttttgtaaaagtgttaaaattttgtttattacatttagatcttgaatgcagtacaaattattttgtgtaatttacagaaataataattgtgagcattttggatcattcctgaatcaaaggaatggttctaattttcatcattatgtgtctggtttgctaaagtttttttgtactgttatatgttttttgctctcttatcaactgcctttattttttgcttttaatgacacatttaacaaattatttttatatatgttctcctttgatagatttattctattataaatatcctgatattgagtcatccttgtatatttgagatatcatacaactttgtcataatgcagtagatatacatacatatcaggatatgatttcctagtatttgcttataattttacatctatgctagtacttgatattagcttttaatttccttcctcattctgtcttagattcaaatgtcataaaatgagtgggaaacagttcctttctttgtaacttctttactttgtaacaaatttaaatttgtaagtatgcttcagaatatttgctaaaattgcttttgaaaatatcaatgaatgaaggggtgaactgattcttaattactgactgaatttccttcatgggttttttcttttaaggttttcatttcttttgttatcagttttgtaaatagcatttctctatttgttctagttttcaagtacactgaaataaatttctttataatattctttttttgttacttgggtttctatattttaattcttgatattcttaatattgattcttaaaattcttcatgatcacttttgttgtttcaacctgtattggtagaatatttgtctttcagtaaacaaatatctaattttgtttactctctctaggtttttattctataactttaatatcatctcttacaaatgtgtttaactctcctcaaatttttggagttcatcctggctttaaagttgataatttggtcattaattttttggtcttcctcccacaaaataaattgtttgcagatataaatttcctgtaaatttctataataattctgttgtaagagttttaatatgtaatattttaccacatattatttctaacttttttctaatgtccaatatgattctttcttttttgggataagatcatgctatggtgcccaggctggactcaaactccctggctgaagccatcctcctgcctctgcctcccatgtgtctgggatttcaggtatgtgccactgtgccccactctatgccatatgattttttaaatctataatgtacatatgattttgaatgtctaagtaaacatctttttacatattttctttctgtagttgctaaaaattcaccttaacattacctttcatgcaaaaatgtggtttacctgataattcttgaaacatagcatcacttacataaattttataaatccaaactgccaatcttgttttataattgttttataactgtctagtttactgcataataatatgttggatgtgtacttattttgtcttctctatttttattgccttttctaagcatttttacaaatattttcttatttcttttgcattacttgagatttgcttcctcatgttttccttttaccggtttggaagaatagagtaaccttagaaccatcagatcccatcacttctctccaaagttacacgttcgaattttactttgttgttgacctctcaatcagacaccattaatttattcagccaatttattttgatttacctacttttatacaagctgcttttcttctcgtaagcaaaaccttttattctgggcaaaaataaattttagcacttccttaagtgaaaattaattagaaataagctctcttgctttgtgtagaaacatattttcatttcctatttggcctccaaatgataggttagcttattttcaaatcatgggttgacaattatttgtttcagaactttaaaaatattattctcctgtactctgacttctattgtcgatgttgaataatcagttgtcactttagttgtgttccttggaagataatttgtcctttccctctggaactttaaaggttctctcattctctctttttctctccactttgtagctttactaagacaaatttgaaaattttgttggcttgtttgagtgtttgttgttgttgtagtttttgaggtggtgtgattctgcataggatttattatgatccctggattcaaaatttgtgttctttgtaaattcagcaacattttttatgcactgttactttaaatattagctctctcaccttctatttatcatttacttctggattctaatcgcatgcttctctacttaatatttaatttcttttcattttttaaagctctttccctcatgttttactctatcttctgtttcattaatactccttttagctgtgtttaatatttatcagtcctctattgtggattttttctaatttaaatattcatattttacatttatatacattgaatttggcttgtttttcaaataaattggttttgtaaacaatagtgagaccttgtcaaaaatattggtataatatcacctgagttttataaatcctctttatatctacaactgcaacatttttattttccttccctaaaaattctaacatttttgtgtacaattttgacattgtatatgatagttattatcttagttttattcagttggtacctacatgcattattttatcttattgataattgtatatatgagtttttttcttagtaaattttcacttaatattatagcaatatcctgtatgacaaaatgataaactatgtgttcattagaaacattatataatagttgacaagtgtacagacttttcaggtggatgaataagaattcatatgcggtctccaacagttacaagttttgtaacttatttgatttctctaaacttcagtttcctaatctagaatatttggatagtaaattggtagcattaaatgctaaaatataaaatagtaacaatataaataacatctgatgtttattgaaaattacactaagcctttgatatcagtcagacatttttatcctcaaaggagaatatgatggtagtcctattactatccccactttacaaatatatgtaatgcatgtaaagcttttagcatattgcctattacattataaattctccgacaaataatggttattattatgtttacaacccttcaatttctgaactcatgaatattgtattattaagagtggtataaaagagcataaaatataaataatatactgtcaaaaccaagattcactgggccactaataagtatttctgttaattccttgcagtaagtatatttgagaaatattataactatttagttactagttcaaagtgccattttttcagttgctaagtaatagaaatatggcattaattcttaaagtatttcagattctctacctgtaccactattgttcccacctcggtcacttatatattctcattctttctttgagaaaatagttgtaaagactttcatcttttctctctcttgttcctttattcttgctctttcttttctttgtagctcctcaccataatgtatagagtaaaaactttcaagtcttctaggatgacaaaccctgaaggaaatggaagagtgaagtttctaatttcttgatttcccttttcccactatatattttaaatatataatccaagagctgctacattgctttgatttattatgtggaagaggaaacttgtaattattaccaagcaaaagtcaattgatattgaggaaaaaatccaaatagaactatcccccaaactttgcaatagcccctttctttatttgtcagccatgtttctttttatttgcctaaattatttcaaaatgttttaccaggatataaaattcagaaatgtatttaaagaagaagaaacagcagaaaggagataatgaagaggtaataacacgaaggtaaaatgcataatctgaagttctgtgtacatggtcacaatttgcatttaatcaacagtgattataagataaattgaaggaactgctcaataatgattacagtttctgatcttaacaggtagaaatttttcccaaggatcataaagtaaaatctgtatatcaaaaaatagtgtccctaataacttatatccattaaacacgggtataagtttcatgttttttataagccatcagcatcttatgaaaatgctatatccttctttaataattttgatattctgaaacatagacgtaaagttgccttccatgaaagtctacttgtttatgctgtaggaaataactagaagttctaccaaaagtgaatatctacactgaagggctcacagatattttttacttttaaattaaatttcactaactataatttataacataaggaaaacccgtgctttcttgacttaattgaatatctagttcccctttcacacatatcccaactaaaactttctccaaatacttcttgcaatctcttgtttagtcaatgtattaggtacttcatgaaggcaattccctttgaagtcaatttgtcctctaaaagacttaagagaaaatccgggcgatagtagacccaagagccagacaaacttactgtgttttaaaaagcagctacttaaccaatgtttcattcaatcgaaagtggttcttttcttggatagttatgtgcacatccttaaaatctcttctgagatcctcatcaaagcttcctgagaatttaggtaaattgatttacttagtctttcatcaattgctctgtttactctttaggagtgatacaatagggcaaagagcagttaaacagaaattcaccttgttaatttttaccacctttcatatattacttaggcacatgacatacagacagacactcagtgggatcattaatggcaacttaaaaaacaattcaactaaaccttgacttatgatcacatttttgaatggtaatgtactcaacaaaatacaataaaactcaactttataagccatgttttctgagctttctctaagttttcctcttacttagctcaatatttgctcaatttgtatgaaaagaagtgtttaaagtacctggtacagggttctgtcaaaaagacttttgtccagggacacatagaggctcatataaaaacaaattcataaacttggcctcattaatgccatgctctaatccaatagtgagagaggaggcagttagaggctggctaggcagatagagagggagagtttcaagagagagacggtgcctatgggaatgcacctgtatcgcccctgtggtgtaactagcaggtggaaatgtggttaagaacttcctcttataccaggatgtctgctcagaagggactgtcccaacttaggcacaggcacaataaattaactatgtttccttaacttgacccactgctaattgtaatatcattatcattgtagttttggcaaaccctgtgggtttcacttagggtagtaaccaaggtggagtcactatggccaaccccaggtatgcacggatgcatcacccctagggggaactttagctcccccatcagggtggaacccacagaagacttccttgtttttgccacatgaaagaaatagaactcagccccttactggcagccctcttttggggcccctctactgctgagagcttttctgttgcttaataaatcctactctgtcttactcattttctggtgtctgtgtgccttattcttcttggtcataggacaataacttggacctcactaaactaaagaataaggagacagcaacaatagcttccacatgtggatcaggaatagggtacattaatttattgatatgggtctgaaaattcacatatgcagagttacttatgtatagaaatagctttgtgttgatatacactgataatttgtgaagatatttatttttaagttagattataagataaatttaatttaaagcatggtatattcatgtttagtttgcatcgttttatcattttttaaattttctccatcattgcatcctaaaagtagagctaggaacatgtccggatctcacagatgaaaatgttcaaaacacttctagataccaaaatacctgtgataataatcatacagtgtatcacagccaagttgtcacagcacacttactggttataaccactgactttttctaagctccttttgtgtatcagaagctttttcttgactttgacggtgtcgggaaatcctaatttccgcagttcactgggaattttagatgatttaatctgatttttagacggtgcttggtcaaaataaaactatctaaaaactcacagagtgacatttaaatgccaagaaacttagacatttcaatctctttaaaacacaataaatctctttgttgaatactccagtttatgcatgcattcactaatctgctcattagttttctcattctccataaatttattgagcagttttgtgtgcaagacagtatgctgagtgctggtgtgatgttttccaggaatttaacaatatagtgggagagagattatgaattacaaaaataatagaagagccacataatgctgttacagcctcctctatgagtactgggaacatttggaagagaaagatacttaggaaaatggggtggagaaagaaagcattatgcagaaagtggaattaaagaaggatgctgaaagttgtggttgatctcatgtgtaatttgggggtagagatgggtgtggtgttgggaagataatcagcatcctagtttgaggaaaactacaggttaaaagatacaagcaagaaaacacaacatgcactgaacactgattagaatgtctgcctgtagttttgataagactggaaagtggaaggcagatggtagtaaagaccttgaatgtctggctaagaattctgaatgctgtgttatgcaacagggaatcctaaatattcctgagtatgaccatgacattgtaagttaaacacttacaaatgcacttgtgatgtacactgtttaaaatacttttgcaaaaaacaagtaatttacttttcataacaactttctaagatgcttagttttattatccaggtatttcatacttggagaactaaaaaacggatacgttaagtaagttgcttaaggtcacaattaggaagtggtagagctgggattcaaatccagacaagtctgtttcaaattctgtgttattaactattacactatcaaagtgagggaaccgagtcagattttaagattaatttgagtgcaaatatgggtgtgttcaaagaactggaaagactaagaacagaattcaataagaagaattttcagcagtatgagcatgagataatgttatttaaaccagagtggtggctgtaggaaacggatgggtgcaatagatacaagtgtccttaggaactcacaactacatataaaaactacagagtaagttaaaccatgtcatttctcaaagaatctatgtctaccaaatatacatagaaaatattagaacttaataatcacatattttaaatgcttgataagatctgttctttttacatacaaactcagcaagtaattttagtaagtaatttttcctaattagggaattattattttttgttgatgagcaatagccgagtgttaaatgtggaaaacattgactatggtttgtcatgttctgttttacgtggtgttaactttctgtttgtgtacctttgcattttactgattccctacagacgaaactgtgtctttgagaattgtctgtaagccttctgggatataaattccaggttattttgaagttatgcctgtttgtatcattcgcccactcaagacatcacacattcttccaaacaccccctacacttggaacaggcacccaattaatatacgccatgcaggccaccttgctcttctccttcaaaaactcctaaaaaaccatctgctctgggaggcattccagctacaataaccacctactactttcaattgcctataatatctgcattcactttcctgaacactgcttacatcttttaccattataaaatccataagacaagataatttctaaatatcttgcagagatatgtaacctcctctccaacatctacattcctttagagtagtagtatattcttgcaaagatttctgccatgacagattaaagaaatatcagctttaaaagaataagagcattaacattgtctcttgtatcaaaatgttcagccaacccagttaggtattctgattaggatttaatgccaaactctcacggagaatgttgagtgacactatctaattagttctttatgaacatatgatagtgtggaaagtaaacaaagtagtgaattgtttttaaattagtgtactttgcttctcaaagttcattatgtattacttgctaggcgacaggaactaattttgattttatgatattttggataaattgttccctgggattaaaaaaaaataagctatgacaagaacacaatttatcaatatgcaaaatagatgaaaccaagacaatttctttttaatttttgaaattgtaagtccatatattgccatgctggttaacaccaaattcctgaatgcctgtgaatctcctaccaattatgtcaacaacatgaatatcttcatagggatgccactgtccaggtaataatctaaagacatgtatcttttactcttgcaagtgttaggccttgctaaatgataaagcgtttttctttgtatttccacagcagagatttcagatcaacagacaagtcccagaggactgaggacaaaataattaatatgccaaagttatataataagaaggcacagtgggagatttctgccaaactaagagggcaaagccctacagtggctgagtggaggaggtgggtggcaaagcccaaatcatgggattagagagacaagagattggatatcaggattggtccccttattcttcaggtcaacacctaagagtagaaaaaaaattcctaagtaaaatatggcaatcaaagaatcctaggggtaatcttgggagatccttctgtgactgagaagaatgatgcccattttcatcattctgtgccatggactgcatggaagtagaaagtagcaaagagcagaaggaggtgtcctatcaagtggatctgaggaaagtcctcgccaagtcacatagaccttattaggttggaggaaaaaagcaccttagaatgacaagactcttgaacaatgtggactcaaaaatgctgagagaatgaactaggaggaaacagaggtcaggacaagtagttggtgggatgttgagaatgaaggtaattacacagtctacaaccatcaggaatagctatcagtcagatgcccaaaatatcagatgggtctccacagcggataccagtgtaagatgcccagagaccaggtggcttctgctacctttcagcagaagtagagaccatctgccatctgggagacagaatcttcccctattgtgactattaatattatatgtcaacttggctgagccatgaggtacccagatatttggttaaacattactctgtgtgtgcctgtgaaggtgtctatgaatgagatcaccatttgaattggtagacagagtaaagcagattgcccttcacaatatgggtaggactcatctaatgtgttgaatgtctaaatagagcaaaaaggctgggtaaaggagaattttttctctctgactgatacatttaagctgggagattggttttctgccttcaggtttggactccactaaaaccgttaccctgtcctacttctcaggctattggactcagactggaactatagcatcagctctccttgatctccagcttactgactgtggatcttgcagcttcttagcctccacaatcatgtgagccaattccttataataaatctctctatctgtctctctctctctctctctctctctctctccatctaatctccaattagttctgtttctctggaatacgctaaaatactcctatgttataagaaactgtgctatgccctttgtacttaaacattgttctgagaaagaggaaagtaaagtcaaagccagtgagttgagaaagatacccagaacaactgggtagttacatcaatgagaaaatgtgttaaaccagagaagactgaactgcttttaatgaacaagatcagctatttacttaatcagtgagatgccccaaactcttacttcaccagtaagagtggccactcaaaaacaaaatgggatcaattaaagaaattaatgaaactcactcttttgcacagtcagacttatgattgtttaatattttactgcttgtattaaagttgttattgctaacatattcctaatctgaagcccatcaagagaatttttgactcttttctgaagtcattcaacaagtttgttttgaattttatttagatttatttggaaaggtacacctgtttttgactgtttagaaaatattaattatcaccatcgatatgcttgcaatatttcctgcccaatagaaaagaacatgcatgacatacatatgtgggcttaaatatctcaagagcaaataaaataatttatacaaaagcaattatttaaaactataaatcagtaagcatatgttattttattactgaagcaataataatacggatcaataggtttctcagaatgtaaaacaaccagggtaattacctagaatctattaacaaccttattctcatataaattccaaattatttgaaaatatattttaaaataatatttactttgcaattgagaaaaatacctgagatcctagaattgcaaattgtatcatttagaatgaaatatttatgcttcatttcatctattaagtctctgaaaaaatatgtggatagcagctaacatttggataactactcctggcaaatcatttcatagtgtaacttgataagggcatttcttactgaaatttttaataagagtcacctgaatgtgaatttaactcagaagactataaagacaaaaatgggtcaagtgaaactgactgaatttatattatataataaaaatcataggtagaatgcaaaaaggaaacaactaatataagctaatttacaatcatgtgtcactttacagaaataccttctgagaaatgcattgtttggaaattttgttattgtgcaaatatcatagagtgtacttacacaaacctagatatttttatttatatatattatatggaaaaccaagtgtcccagcaccattactgaatatcaatcatttcctctacttgatttgcaaaaccaatatcacatgccctatattaagtttctataaaggctccattaaatcttacagaacgtatgtgttccatcactggcttaaacattgtaacgtggtccatgactgcatgcgtgtgcatggaaatggaaatagcaatggcttacacatatagtgattactacgctccaggcactgttcttagtgctttagatgcattaactcatttactcttttgtactctatggagtaagaaccattattgggtcattttacagaggaggaaagtgaggcacagaaagggttaagctgcttgttcagggtcacccagttactaagtggaggagcctggatttggacatgggttgtcaggttccagagccaccacagtcatttcttgtcaccaccacagccatttcaagcatccggttacgtggttctggtagatattgccttttctaataaagaaataagcaaaatcgacacagataagggactagtttgctccagagtctctattccatgcattttgtgtagcacatatggttctggactagaaagcattacactttgcagagaatctcagtttctccaccaaggctcaaaattcccatgctacttaaaataagtctccttaagttccccattcactgcatttctaaccatctccattgtatcgttctctgtatgacagaacatgaagtttttactccttttatctgttctgaaatttatctgtaatttttcgaacactttctctcagagctacagtttttcatctatcacaggagtagtaaactttctttgtaaaggcccagatagtaaataatttaggctatatggatcatatggtctctgtcacaactcagctctgcccttgtagttcaaatgcagccaaagatagcagaaaaacaagtgaccttggttgtgttccacaaaacattccttttataaagtaagcagagggccagaactggcatatgggccatagtttgctgacccctgatctgtcttattacttatcagtgggaagtatgtatatcttgctttgtcttttttgaagggagtacaattaagggttttcttggaagtgtttcattaatattatttttgtattatatcttattgatatatcatagttacacacattgcagatacatgtgctattttgagacatgtatataatgtgtaatgatcaagtcagcctaattggaatatccatcacctcaaacattcaacttttctagtgttagaacattacacttcttctcttctacctgttttgaaatataccacacattattgttaactatacttttcctactgtagtattgaatactacaacttattccatctatctaagtatatttttgtacccattgatccacttctaatttgaaaatacttccctattttaaaaaatcacttaattctatggtatttcctgtatgtctctagcagacctatgttcttttattgactaggattttgactgcaaacacattttaaggcaattatttagtagcctatgtttttacaaacattcatgttcaatagttgcagtaactctgtgagattgtcttaagaaaaccattccaatttacaaaggtagcttccacgttcaggaattataatatggcttttaaatctaaattttgtgctcttgtgattatgtgacacgatctttgcattatatagaaatcatatatgattgctatcagatgcacgttaacttttaaataataaagctttcaatgaactttcaactccatttttcactttctaagaatcacctaatatttctgacacatctttgtaaatcccagagagttactggacccctgcattatagcatcaatatcctgcatacacttgagtcacatgatagttttgatagtaaattctgatgggaataaaaacaaaagaaatggtattactctagctaacatgacatgtattattcaatttaatttaatagtataacaatcctgagaactaagaatcactattctactctcataggtgatgaaatggatgctactaaattctaaataatttaccctaggcttcagaactggtaagaggcagaagtagaattcagacacagatagaaccgaaggtttgtctttttcatatgacatcagaagtgtctcctggttatctatggaacccaatatcacgtttgaacttcccaaccatcaatatactttttaattttctataaactctgtttagaattctctgtatttctttatgacaaccaggaaaacttgcttataccatttgagcagtgaagttaaaaatcacagacataacttcaatatgaattttattactggttatctgctagagagcttggaacattctgaatggaattaaaatgcatttcattggtgtggaatcatgaacatttgttaaaattgttttgtaaaaaactccctaggttttcacagctgtagaaatgctccctcaaagaaataagtgcagaatgaataaaaacagatgtggcatttttgcatattatcaacaaaaatctctttttattttatcttgtcaatgtcttaccataacattatttatgccattattctgttcacaacaagtgcaaagaaattacatgacatttccagtacatatactggtcttcagtagggttttctggttacttatatttctctagagagtacctttgcacaggaagtaattttctatgttttctaactaaaacccaacctttctggctgtgcactctgagaaacagcaaacattctccactctattaaaagtaattgagtcggaacatttaaaggtattttaaatgaatgtgcactgaacattcttcaacttggttcaggaaatagatataagaaagtttttaataccctgaaatttttaagaagaggaaattacctttggttatttaaagctagaaaagattgggtttaagaactttaagacaacgggctaaaatcaactccaaggcaatgaaagcgtcttcctttaaaaagtcactagtgttttgtgtttataaatttgtgccttcactgttgaatttgtgccttcactatttaaaatgtatacaccgtatacaggtttagcatttctaatccaaaaatccaaaatccgaaatgttacaaaatctaaaatttttgagggccaacgggatgccacatgtggaaaattcaacacgtaagtacttaactcaaactctgttccatgcacaatattattaagaatattgcatgaaattattttcaggttatgtgtataaggtatatatgaaacataagtgagttttgtgttttgtgatagacttgggtcatatcaccaaaatacctcattatgtatatggaaatatcccaaaatataaaaaagtctgaaatctgaaatagttaggatcccaagcatttcacataagagctgctgaacctgtagtactcttttaggcactcagatgtagagtgaagttaattctgtataatataagctaaaaaacataatcattggcagtacctagtggtaactcaagctttcaacatcattagaatttgaggatgttaatatacctgcacaaaacaatcctatgtgacttttcaaagatgaaattgcactcagtgtggtcaaatgaagaaattaaatcatgctatgaataagtgatgttttattaggtagatgttctagcaaaacctaatgctttacctgagaagttaatcacttcttacattatttttccaattgtttgtcttcccaagagttgtgctaacttaatattaatttgatatattagctgtattcacttaaaagtttacacaaaaatattttaccatttgtaattgtttcaagtttatataaagaattaaatatattttaacaagcatctacataattgacatgatttttttctaacctgaaaacctaattatcaccttcttatagaggacaaggaacagctttgcaggcaaattaatgtatcctatcagtgggacagtttgtcacttgcttaaataatcatcatctttgttataagctttacagaatgaagaaaagagataggacccctctcatactattacacattaaaattaacttcccacaggtttttcaacagtttcctacactttcactgtgctgaatcataaagtagaaatgacagcattaactgcttttcaagagataagaagcaaatatatttcatatcagctttgtcaaataaagtcttcagtcaccacacagatacatcatatatttaattgtacacaagttaaaaagtatgccgcatgttaaaataatatgatatcatagtgcactagtaaagagggtatgtaaaaaggactgcgttattaacaattagttgatattattaagtaattacctaaaatggacacctgccattaatttctgtacaataaagagctggcacatgctaaaactggtttccttattttcttatctaactgggtaaagttattaaaattacggtaataaaggcacctaaaatacacaagatttgttaaaatgctcttaaagtaaatatagtattgcttgcattttggaaactttaaaaaataatattcttgctattaattgctatattaaagctattatttctaaactgaattacttataaataaaaaagatttttttaaagactgatctcagttccaactagcaaattatttcagacattttgcatttatttaatttccaatgctgcaattaagaaagaacatcaacactttgacttttagttggtctgaagcaaagtcccttccacgtgagattaaaacttgtcttgttcatcaaatgggatcaaaagctccttaattagtaggctggactaaggtacacagatgccctttgacctcctatgacagattgctaacattttagcatttacaacagactctcaagtatgccggctgacattcaaatataactcaaattacacttggttaaaagaattgtatacatctacatgagaaggactactggtgtaaaaaatctaagtcccggcaacgcaacacaaatcaaaacaatgactttgccagtatgcttaatagggaaggactcatccagtgttctctggattgcgggaagtgcggcaaggctgagtgcatgtgggctagcgccctctgctggttagattcttcaacgtctttaaatcaagaatcttcaagccttgattaaaaaaaacgatgctctaaagattctttctctttctggaattaggaatctatgggaagccttctaaaaatttaaattttaattcgatttcaggtattctaaccacctgaatatttatgtgaggatcacaataaaattagatccccaaatttcttttaaaatttaaattaaaaatttaataaattcttatgactacataataagtgaaccatctgataaaatagtgtaacaataaataaaataagttaaataatttaaatttaaataaattctgaataaatacctctgataaaactaatcgttaataatatagtgtgcccagcggtggctggcaagatggctgagtaggaacagctcctgtctgcagctcccagcgaaatcaatgcagaaggtgggtgatttctgcatttccaactgaggcacccagctcctctcatttggactggttagacagtgggtgcagcccacagagggtgagccgaagcagggtagggcgttgcctcacccaggaagcacaaggggtcagagaactccctcccatagccaagggaagccctgagggactgtgccatgagggatggtgcatcccggcccagatactaagcttttcccacagtctttgcaacctgcacaccaggatattcactccagtgcctacaccaccagggccatgggtttcaagtacaaaattgggctgccatttgtttgggcagacaacgagctagctgcaggatttgttttcataccctggtggcgcctggaataccagcaagacagaaccgttcactctcctggaaagggagctgaagccagggagccaagtggtttagctcaggggatcccatccccacagagcccagcaagctaagatccactggcttgaaattctcgctgtcagcacagcagtctgaagtcaacctgggatgctccagcttggtggggggaggggcgtccgccattactgaagcttgagtaggcggttttaccctcacagtgtaaacaaagccactgggaagttcaaactggacagagcccaccgcagcttggcaaagccgctgtagccagactgcctctctcaattcctcctctctgggcaaggcatctctgaaagaaaggcagcagccctagtcagaggcttgtagataaaactccaatctccctggagcagagcacccgggggaaggggtagctgtgggtgcagcttcagcaacttaaaccttcctgcttgctggctctgaagagcatgttctaacccaatgcaaggaagcaaagaaccttgaaaaaaggttagatgaattgctaactaaaataaccagtttagagaagaacataaatgacctgatggagctgaaaaacacagcacaagaacttcgtgaagcatacgcaagtatcagtagttgaactgatcaagtggaagaaaggatatcagagactgaagatcaacttaacaaaagaaagcatgaagacaagattagagaaaaaagaatgaaaaggaatgaacaaagcctccaagaaatgcgggactatgtaaaaagaccaaacctacgtttgaatggtgtacatgaaagtgacagggagaccaagttgaaaaacactcttcaggatattatccagaagaacttcaccaacctagcaagacaggccaacattcaaattcaggaaatacggagaacaccacaaagatactcgttgagaagagcaaccccaagacacataatcttcagattcaccaaggttgaaatgaaggaaaaaatgttaagggcagccagagagacaggtgaggttacccacaaagggaaccctatcagactaacagcagatctctctgcagaaaccctacaagccagaagagagaggggggccaataatcaacattcttaaagaaatgaattttcaacccagaattccatatccaggcaaactaagcttcgtaagggaaggagaaataaaatactttacaggcaagcaaatgctgagagattttgtcaccaccaggcctgccttataagagctcctgaagaaagcactaaatatggaaaggaaaaactggtaccagccaatgcaaaagcataccaaattgtaaagaccatcaatgctatgaagaaactgcatcaactaacaggcaaaatatcaagctagcattatcatgacaggatcaaattcacacataacaatattaaccttaaatgtaaatgggggaaatgccctaatcaaaagacacaggctggcaaattggataaagagtcaagacccattggtgtgctgtattcaggagacccacctcacatgcaaagacacacataggctcaaaataaagggatggaggaagatttaccaagcaaatggaaagcaaagaaaaaaaaaaccagggattgcaatcctagtctctgataaaacagactttaaatcaacaaagataaaaaaagacaaagaagggcatgacataatggtaaaggaatcaatccaccaagaagagctaactctcctaaatatatatgcatccaatacagggggacgcagattcataaagcaagctcttagagacctacaaagagacttagactcccacacaataataatgggagacttgaacaccccactgtcaatatcagacagatcaacaagacaggaaattaacaagagtattcaggacttgaactcagctccagaccaagtggacctaatagacatctacagaattctccaccccaaatcaacagaaatacattcttctcagcaccacatcacacttattctaaaactgaccacataattggaagtaaaacattcctcagcacatgcaaaagaacggaaatcataacagtctctcagaccacagtgcaatcaaattaaaactcatgattaagaaactcacccaaaactacacaactacagggaaattgaacaaccagatcctgaatgagtacggggtaaaaaagcaaattaaggcagaaataaataatttctttgaaatcaattagaacaaagacacaatgtaccagaatttctgggactcagctaaagcattgtttacagggaaacttatagcactgaatgcccacaggaaagagcaggaaaggtctaaaatcaacaccctaacatcacaattaaaagcactggagcagcaagagcaaacacattcaaaagctagcagaagacaagaaatagctaagatgagagcagaactgaaggagatagagacacacatacacaaaaacccttcaaaaaatcaatgaatccaggagctgttttttttttttaaagataaacaaaatagaccactagccagatgaataaagaaaagagagaagaatcaaatagacagagtaaaaaatggtaaaggggatatcagcactgatctcacagaaatacaaactaccatcagagaatactataaataccactatgtaaataaactagaaaatctagaagaaacggataaattcctggacacatacaccctcccaagactaaaccaggaagaagtcgaatccctgaatagaccaataacaagttctgtaactgaggctgtaattaatagcctacaaaccaaaaaaaagcctaggaccagacagattcacagccgaattctaccagaggtatgaagaggagttggtatcatgccttctgaaactattccaggtgatagaaaaaaagggactcctccctaactcattttatgaggccagcatcatcctgataccaaaacctggcagagacacaacaaaaaaagaaaatttcaggccaatatccctgatgaacactgatgaaaaaatcctcagtaaaatactggcaaagcaaatccagcaggacgtcaaaaagcttatctgcaacgatcaccttgacctcatccctgggatgcaaggctggttcaacatatgcaaatcagtaactgtaatccatcacataaacagaaccaaggacaaaacccacatgattatctcaatagatgcagaaaaggcctttgataaaattcaacagcccttcacgctaaaaactctcaataaactgggtattgatggaatgtatctcaaaataataagagctatttatgacaaacccacagccaatatcctactgaatgggcaaaagctggaactattccctttgaaaactggcacaagacaaggatgccctctctcaccactcctattcaatatagtattggaagttctggccagggcaatcaggcaagagaaagaaataaagggtattcaaataggaagagaggaagtcaaattgtctctgtttgcagatgacatgactgtatatttagaaaaccccatcatctcagccccaaatctccttaagctgataagcaacttcagcagtctcaggagaaaaaaatcaatgtgcaaaaatcacaagcattcctatacaccaataatagaccaagagccaagtcatgagtgaactcccattcacaactgctacaaaaagaataaaatacctaggaatacaacttacaagggatgtgaaggacctcttcaaggagaactgctcagggaaataggagaggacaccaacaaatggaaaaacattccatgctcttggacaggaagaatcaatatcatgaaaatggccatactgcccaaagtaatttagagattcaatgctatccccatcaagcaaccattgacttttctcacagaattagaaaaaactactttaaatttcatatggagccaaaaaggaggctgtatagccaagacaatcctaagccaaaagaacaaagctggaggcatcatgctacctgactgcaaactatatgacaaggctacagtaaccaaaacagcatggtactggtaccaaaacagatatataaaccaatggaacagaacataggcctcaggaataatgccacacatttacaaccatctgatctttgacaaacttgacaaaaacaagcaatggggaaaggattccctatttaaaaaaaggtgttgggaaaactggccagccatatgcaggaaactgaaactggacccctaccttacactttatacaaaaattaactcaggatggattaaagctggaaaccatcattctcagcaaactaatacaagaacagaaaaccaaacaccgcatgttctcactcataagtgggagttgaacaatgagaagacatggaaacagggaggggaacatcacatattggggcctgtcagggggtggggggcctagggaagggatagcactgggcataatacctaatgtaggtgacggatcgatgggtgcagcaaactaccgtggcacatgtatacctatgtaacaaaactacatgttctgcacatgtaccccagattggctccaaagtcatttgtaaaacttctctttatcttttaaaataatgtatcaggttttatgcaaaaccttcctaatcagcactatcccatcactgcataagaagtattttctcctttgcatcctctgtgtatgatactccaaccactgcactcatcttacagtattatatatgtgtttgcatgtatcttttccccactaagctataaactctaagtggttggaatggtgttaaactcatcttctaccctgagcaaaagaagtcttttctggaacatattagccttgcatcaaatgagtatttatctagacagaatgtttagtaaattgctacatatgtaaactagagcaagttatacttctgaatttgttttctaatatgtgaagtaaaaataataattgtaactatctcctaagattgtgtgtggattaaataaaataatccagaaaaatcatttagtagagtatctggaacataccccagcctttaagaaatataaatgatgagttttattgtagtctattgccacaaggacacacaacttacacgttaggtttacaactgtttattaggctataataactgagaataaaaataagattgggactaacgattagtgatattagcttaagttttcatggtaaccaagcttttttttttttcccctagtaagatgtatagatctagaaaaagcaatagaatttttttgtaactttgtgttcttttctgtatgtcatatgatactttaaattactttagttatatttgaaaataatttttatcattaggtgagtagaaaacaggctaaagcatccaggttgaaatgtaaaacagccaaaataattaaagtaattgaatttgaacataaatgaattttatattcataaatttgcaaactacatgaatcacagtacatgaaactttctggtattttagaagttattgccaaaattccaaatgacttttgtaatttaaatatgccttaaagattaaagcaaaatgaattaaataagacaaagttagtaaaagtaagatgaaaagtaagtaaacaaaatattaaaagaatatgtataaagaacaaactgtgtctacatattaaaaaccaaacaaattatgacatcacagtgactactaaacatcagtaagtaagaagagtgcatagtggcatgtgctctgcatagacataaatgtacatgtaaagatttattctttaaaagcatataaatgtagagatgcttgcttgcacagcaaatggttttgttacatcaggatttctccgtgtacttgttagtatttttatcacatcattaaaaagtttcagtagaagatgaggatcatagaaattcagatttaagtgacctccttaaagctgagaaatgaactgccaaacccaaagtctttgcaaagcccaactcatttttaaaatatatgaaggttttggcagagaatgctttttgacccgttattcatttttctttcttcctgtgtacacaagaacctctcagactttatgtgagcacatgacaccaccatgcccctgccagagatcacattttcctgagctcttgcctttaagggtggctaggtcactaagttgtgatatgagtagcagcgacaggggcgactctcagtggaaaaacttggtgaagatgctgtgggcattggacatgggtatgagaagaatactttttggggatgtcttctccagtcctcagacagaaagaggcacctcctcctggtagcatatcgtactccattttgcatttacctcactgatagtctttaccacatgttactgtgattccatgtttggcttttgtcttccctgtaggcccaaaggctttacaagagcagagaggatatttcatattaacattactcattctccaagtactttcacattatagaactataataaatatttctcaagctatacaaaataacgaaaagaaaacataagagtctgcaggtatgatcctgatgatgaattctgactttgaaagaacaatcaaggcaaaatgaggaaagcttggaagagagtcagaatgtcctgggaataggtatagaatgaatccaaggaaatgccagatggtgagacttggaggcaataagtgataagatgatcaatcataattgctagtatttgggggaacacaatatttgctagacactgttaaaatgttcttcatccagtgttaatttagttttgcaacacagcccccaggttgatgccattagtatcaatcctcattacactgattagaaaattggggcatggagagaggagaaattttcctaaagtcacacagttaggaggtggaagagccactatttgaagccagggagccctaactagcacattataaatatctgggggaaagaagaggtaaattgaggagacccaagcatgactccgcaataacatcccctgcttattagcgttgtcttaattcttcatagtgaagtatggcccataggtcacacttgctcacatgtgatatatgtagtgtgagccttactcctagctgctggtgtacacaattattgagactttctgtgatgcattatccatcggatttgcatgagttggaagtagacgtttgcatgtgcacacaagctggcctaagaacagaaatgagccatcaacagggagggggaattatcatataaatcctaaacatttcaagtgtacatctacttccagggatcataaacataaaaaggttaaataaggcaggagttgtcagtggtttggtgactatgaaacaggaatgaggtaatcaaactggtcttatctttcattgaaaaatacgaacaagcgctcattgagtgcctaggagcactcaacaagctttgatcaacagagctttggaccatacttaaaatagcaacattaaggccaggtgtggtggctcatgcctgtaatcccagcactttgggaggccaaggcaggtggatcacgaggtcaagagatcgagacaatcctggctaacatggtgaaaccctgtcctgttaaaaatgtaccaaagaaagttaaagtcgattttagtaccagcaagaccagttaacaccttagaaatgttttttaaacacagtgacaggcctaaacagttgcagccagtcaacactgcaaaataggggcaagaaccttggaccaagattcactagagtgtaatttactaatcacaaggagggtttcttgtttactactgtatcctcagtgttccataaatacattcaataaatctttgttgaatgaataaaccaaaaaaaaaaaaaaacacaaaaattagctgggcatggtggtgcacatctgtagtcccagctacttaggaggctgaggcaatagaatcgcttgaacctgggaggcggaggttgcagtgagctgagatcgcgccactgcactgcagcctggcgacagagcaagactcgtctcaaaataaataaatagcaacattaataacgatggcgtttatatagagaggctagatggattcagcctgatgactttgtcagtctcttattttgaccagtcaagctactaaagttcctatctagggagtgatgtggagctgtgcttgtcaaagcacatttcttggactatgtccatcagagtttctggaggacatggtcaaaaatgaaaatttctggactatgccttgaaccaattaaatcaaagcataaaaggacagaaagttgtatatacatgtaccatatttatgcttaatgagtttttgtatgttatgtatataactattatatgtttatataagctaattgtcataaatatatttatttatataattattttattacttactgtttttaaatattttattacatacttatttatataactattaactatattatttatataaaattgctagaaattttctaaaagaaattttaaatgttaattccacaaaagtatatgagttaatgcatgtgtgaaatatcttgatttagccattccacaatgtatacaaacatcaaagaatcctattgaacatcataactaaatacaacttatgtttttaataaaaataaaatataaaatataagtaacagacaaatatatgtacgcatattatatatatacttatataaaacataacacacatttttaattctgtatgatgtaattattatgctgactgaagtttgggaaccatggcattacatatcccaatatgaaaacactgttaatgcagaaaatacaaatttcaaaatgctgcatatgtgagaatattatttttctcttcaaagagcaatgtttatgagtgaaccattttttaaaaaataaatcattcaagggtaatattttagaattaactttgttcagtcagaaaataatgttgaacattttcacataactacatgtattccaaaagaaatgcatgagtaactaatgcttatgtggagggagaagcaacgcagaggatataattagttccaattagccatgccaggggattactttctaggtaagattacctataatgaggtgattaacctctttggaaaaagttcaagccaggcttaccttctacttaatatgtcctgtaaagaagtgttacaacgagggtcctcacaattgttccctgggataattgccaccaagaatcaattgattctattccagaagaatcaaaaagcattcttattatattattgatagaatgaatcctaacacatctatatattagaaattaagtatttaaatttcatatcaaattaactaaattatatggcacggattttatttatactaacaaaacagcaattgaactctagtcaattccaaatacagatctatcggctatctatgaacatcaaaggggaagaaaattctatcattgatattggttaacgtcacaggcttatttccaaaagtagactgtccattgtctaattagtttagagggtctcttctgtctccagcacacaattgaattttgttgcagttggagaggctgatgctaacctaggtggcagggctgaacacaagggaacagaagcttcagtgttttcaccataaaacacgagataaattgaggatagggattttggaaataatagatttaactgttgtccaagcttatctgcagtttcttccctttaaactaaattgatagtttacttattatggactaattaaaattattatatataatattatctatgtaatatatctgttacatatatatattgttgtcagcttataaggaacaataaataattttctttgtgttttaatttaacaaatacttcctgaaagtttgcgtgtaggcatacaagctacaacaatgagtagaaattttttctaaaagtggttttttactgtttaatactcttccctataagaaaatacttaaacttgaattattcttgtaatcttgtggacatctctgaattaattactgttactttacaaatcttgtttctttatttgttatcctagaagtatttgtatgtgtgtgtatataaaatttttgcatagaccacatgcaaattcatgtaaagtaataatacaaaccctaggaatcgaaaggcaaaatcaaggggaaaatatttaaaatatttgcatggaaatgataataataaaatgtaagtgtcttgcaaacagaaactagaaataaatatttctgttttatttaaattagagcatatacaatcaagccttacttcagcatgtatctgttagagctcaatggtcaccttaatttgggagccccaggaaatatcttccctctgtaaagttacaaagtagaatttttctctggtttatattcttctgtggaatttacgattatctaagctctctctgatcccaagttccatttcttcatttatcttagattctaaaaatctaggccttagctgaatgcccatcaaacaaacagggctccttagtaaatgtttgcagacaaaggaaacaaccaaatcaatagcagataagcagtattttatccaagcttcagaaactttattaatattttttgttacttcactgcagtggcaaaaataaaaaatgaacaggagaataaaaaatgtggtgtgaaagaagaaagagagtgaggggcaaaaaaggaagggagaaaagttattcccttctttattcatcctccagtcctcactcactctattccaaagagccatcttacaaacatgattttaaacagcctggatacagaagtaagtgttctggttttattaatggtgccaagaaatgatgcaggaagcttcaggtgaattgaaaccccctgcatgagaacacacacagtcctgactcatttaaccattctcatttctacctgctcagatccaacaaagtatttaagcaagtctcaacatacaaataaaaatatatgaatcgaggagcatagtaaattattttaaaagctttacattaggaatacacacatagaagagcacatataattgtaagagatttatataaatatgataaaatgaaaactcttagcaaatatatatgtatacaaatatataaatcgatgcatcacaaatacatatatgtatacacatatatacatctatatatttacctatttatctgtacactatatggtttataggcaaaccgtaatttagtcatatggaaaaactggcctcatgataatgcttacacacacaaatttcaaaaatttcatttaaatgatatagcaaagtattctaagttagaatgaaaaatgagtatgtttcttctttaaaaacacatcaattcattctagtacacagaaactaaagacataaaagtgctttaggacatgaaactctcatgaagatatgattctcttcaaaaggtccctgcacaacaccactatttctaataaaactgattttattcaaaacactaaaaatgacaaacatttaacttttaatttcagtagtcctgtttacctagttggctaataaaagatagtgacatatacacaaggtagaagtgtgccttaaaacatgataataatttacatttttaaatgaaaaaaattcagtctacaataatgaacttgtcttgactgaggcaaaagtgaggtcaaatacctgaatgatgacattgtgatatacttcatcctttctttactttcactgtttttaatagattgtgaatgtcagtaatttaaaaatcaattgtactcctgaaataacagtttaattcctaaaagtttaaagtgaaagaaaacatgaattcctacaaatgtgattctacaaagatacatgttaaaagccttcagaggaaaataaatacaaatatctcctatattctatttgctatgtcatacctgactcaaaaatatatgtaagatacacatttaagagaatatctcatgaaattgattggatgccaattttcaattggcttttttcatttgtacattaaagattcttacagaagatcaagaaaattataaatatgaatacatcaacagaatatatcatcatgatgtaagacaatttgaattgctctggaacttcaaaagcattttgttgaattcacagaaataatttctcaatggtactttatatggtaagtaaaaatatttggctttgatatagcatttttctgtcactactgaaatattatatttttaacttctcattatattctagaactttaatggaatttttatctctagataacaaatggcaattttgtgttctattactctagtctgtgggcttttctttgtctctatagcaaaatagaaaaaaaatacacaggtttgatttttctattcttagaaatgataattttccatatatatggaatatatgtatatatacatatatgtatggaatatatgtatatatacatatatatgtatggaatatatgtatacatacatatatgtgtatggaatatatgtgtatacatacatatatgtatggaatatatgtgtatacatacatatatgtatggaatatatgtgtatacatacatatatgtatggaatatatgtgtatacatacatatatacacacacatatatgtataagcatacatatatgtataaggagagtgatattttatatttagtcttcagttcaataccatcaacacataaagaataataatttgaaaattgtatactgctgacatataaattgataagaagaagcacaaactaatctataagtaatctcatattatttatttgtaggacacagtgctcagggatttatgttaaagaatttttgtttgttttgcattgctggttcttgaaggttatgtacgtaaaggctgagaaaactaaaaggtattaatacctcaaataatagttatgtagaatgaagactcactctacatatcacagttcaatctttattgcattttttgcactataaaagcataaactataaaggtagtaagatatatagaaaaatatagagaagataaatataccatgaaatagtaaataacttacagaataaatacctattgagtacacagtatgttccacaaactgtgtagttactaaagcccaagaaagaaaaagcagaaagtagtacagaaataaatcacatacttctgaccagggggctgagaacctatctttgtttcattccaaaaattagagaccagatactttgaaataagctgcgtggatttaaacagtattattgtgatcgctggccataagtgcttactagctaacttcttttagtttattctagtaaaatggttttaggtgttacacattaagaatttgaattgaatcactgaaatcatgctatgactagatttttaagaaatctttgtaagaccacctgatacggtttggctgtttccccaccaaatctcatcttgaatttccacatgttgtgtgaggtacccagtgggaagtaactgaatcatggaggcaggtctttcccatgctgttctcatgataatgaataagcctcacaagatcggatagttctgtaaggaggagtttccctgcacaagctagctctctcattgcctgccaccatccacgtacaatgtgacttgttcctccttgccttccaccatgattgtgaggctttcccagccatgtggaactgtaagtccaataaacctttcttttgtaaattgtccaatctctaattaatgtctatcagcagcatgaaaacggactaatgcaataaattggtaccagtagaatggggcactgctgaaaagatacccaaaaatgtgagagcaactttggaactgggtaacaggcagaggttggaacactttggaggactcaaaagaaggcaggaaaatgagggaaagtttggagctatctagagacttgttgaatggctttgaccaaaatgctgatattgatacggacaatgatatccaggctgaggtggtctcaggtggagatgaggaactggttgggaactggagcaaagatgacttgttatgttttagcaaagagactggtggcactttgtccctgccctagagatttgtggaactcaagagagatgatttagggtatctggaggaagaaatttctaaacagcaaaccattcaagaggtgacttgggtgctgttaaaggcattcagttttataagggaagtagaacataaaagttcggaaaatttgcagcctggcaatgctatagaaaagaaaatcccattttctgaggagaaattcaagcaggctgcagaagtttgcataagtaatgaggagtcaaacgttaatccccaagacaatgggggaaaatgtctccagggcatgtcagagacctttgcagtaggccctcccatgataggcccagaggcataagaggaaaaaatggttttgtgagccaagcccagggtgcccatgctgcgtgaagccaagggacttggtgtcctgtgtcccagctgcaccatccatggctgaaaggggccaacatagagctcaaaccatagcttcagagggtgcaaggctcaagcctcagcagctcccacatggtgttgagcctgagagtgcatagcagtaaagaactggggtttgagaacctctgcctggatttcaaagtatgtatggaaacgcctggatgcccaggaagcagtttgctgcaggggcaggactctcacagagaacctctgctagggcaatgaggaagggaaatgtggggtcagaacccccacaatgcatccctactggggcaccacctagtggagctgtgagaagagggccaccatcctccagaccccagaatgatagatccaccgacagcttgcaccatgtacctggagaagccccagacactcaatgccagcccgtgaaagcagccaggatgggggactataccctgcaaagccacaggggcagagctgctcaaggtcatggaagcctacttcttgcatcagcttgacctggatgtgagacatagagtcaaaaggagatcattttggggctttaagattttactgccccactggattttgcagttgtgtgggggcatgtagcccctttgttttggccaatgtctcccatttggaatggctgtatttactcaatgtctgtactcccattgtatctaggaagtaactaacttgcttttgattttgtaggctcataggcaaaagggacttgccttgtctcaaatgagactttggactgtggacttttgagttaatgctgaaatgaattaagactttgggggactattgggaaggcatgattggttttgaaatatgaggacatgagatttgggaggggccatgggcagaatgatatggtttggccatattcccactcaaatatcatcttgaatttccatttgttgtgggaaggacctggtgggtggtaattggatcatgggggtaagtttttcccatgctgttcttatgatagtgagtaagtctcatgagatctgatggttctacacgggggagtttccctgcacaagctctctctctctttgcctgctgccatccacataagatgtgacttgctcctccttgccttctgccatgattgtgaggccttctcagccatgtggaactgtaagtccaataaacctttcttttgtaaattgtccagtctcagatatgtctttatcagcagcgtgaaaacagagtaatacactgccaatacttttcctataactggttccattttgcaagttacttggaagtccttttcaatgttacatagttttacacaaggaattccacactgctttgcatgtttttctaaaatcattatacgcctttataattgccctttttaatgttgcttattttagtatggtaataaataattattaatatcctttttttcaaaaaaggaagtatttaaagtcatctctctaaatagcaccatgagaagtattatgtatgtgaattatgaatgtaaatatgtttatgaatactaattgacaatttatataaatattttaaataccaatattatgtaataaatagtttaaaattctagtagcataaatatttagtttttttttttcttgagtctaaaggactggaagtttttattcaaattccgtttgttggaagaatatcttaaagtttagaaagttaaacagcatgctttcttttaacagttaacttagatttatatagaaatttggaaagaatatgatataaacctttcaactagcactctcttaagcaacggaaaaatcattacctttccctgttctttcaatttctgtcataagaagcatagagaacagaactatatattgtggtaattaatttccttaagataatgttagaaacatcatgttctttaaaatataaatgaatttcaaggtgagcatgctagaggataatattaatggcatgtgatttattgtgacaagagatctgatctgaaataccattattaggagtacttaaaaaaatccatttgcaaattcctgaaaatatgaaagtgtgctatggctgagcctgtcgcaatgttgaaatctgaactatctgccattgtaagtatgaaattgcttgggtacaatatgtcttcctcacagaaattcatcagaaaatgttcatatcctgaatatatcacattatggtttagggaattgcctaaatgcttgaaatgataactgtagacttaatctgcaaatgtatagattgaaacatacatgcctaattgacgtggtaatatatggaattctgtggctgatcattatcttaaaaaatatttggccaataatacattgaacatctactctatacctggttcttgaactcgcaatagaaacctgtgactttgtgtcattttagagagcattttctatgttattatctctagcaaagactccctataagctatttataagcgaggttcattcatgactcaaatttgcaaagaagttttaatacagttagttttacatcttataaaaaacattgaagtttacaaacacattgttataaatggcatctaatcacatactgagcagtgaggaatgtcacaaattagtagagctattagtaataaaagattaaatagatatgtgaataataggagtctttatgagtaagaagacttaaaaattattctgcagaaagaaattcattagcctctgatgcttgagagagggtaataaatattggcattcttacacataggttgtcaaatatgattagcacataaatatattgatatatctctctataaagcctttaatgaacttttttatgttaaactctctaagaggtacactccaaaaggtattatccaaacacactttcgttttttgcttgaaacctattttaatatatgaatataaacttctttatgaatataacttaaataatatatatgaatataaatatgaatgcttcatagaatgacatgtgggaaagcatagactactctatcttataatatgttttgtacacattaatagctatattcatttccaggatatttgaggtgtataatcaagtgctgaaatctatacagtacatatactttcactgttatgtcaatttatttttacatgtgtttcatgaactgaaactaaatcttgtaaaataaaaatgtctattctaggtacaaaggcaacttatagtgcaaaattttaattagattactttgatttaattttgaaatgcacctggagaaaaattcaaacagtacaataaagaaaaatacagttgtcaccacaaccactttgttcccatctccagaagcaaccagagttataaaatttgtgtgaattattctgaaaatatatgtacacatatatatccatatatgcatttatttcattttctttacgataaaaagtatagttttctgaactataagaaaaaagcaaatcataaggtcatgatttatttgtagggtaaaaaacaaatcaaggaaatacccaacataggtattagattatgtttttagttactaaaaacatttttttttttttttttgagacggaatctcactctgttgcccaggctggagtgcaatggtgcaatctcagctcactgcaacctccgcctccagggttcaaacgattctcctgcctcagcctcttgagtagcttgggttacaggcacccaccaccacgccctcatttttgtatttttagtagagacatggtttcctcatgttggtcaggctggtctcgaactcccgacctcatgatctgcccgccttggcctcccaaagtgctgggattacaggcgtgagccaccgtgcccggcctactaaaaagatctcaataggtaaatttaaggaaaaattagatacaaactcatgaaacatttgctgtgatgatttatgcataaagtagtgcaattttaatatttagaaaactataaaacaattttgaaatagtttttaacagcattttatttattgtgaacctacatgggagaagattacatcaatgtactcatgagtgacaaaactgaaataaatttaagaatgtccaggtgcaggtatctaataaatggtctataacatttatggcaagatgtcagccaaatgcagcgacaataaagcccttggctttgaatattaatagataaagtcacttaaatatctatacagaaatgctagttatggttttgtagctttgtgagctgaatagagtggaaatgagtataattgaagcaaaagataattcacttcttctgccccacttttctaggggagtgaggtggagagagccatatttccttctagaaatggggaagatacggaaccaaggctttcctgtttccctgagtaactgtgaaggtcaatgtctacatttttgaagaaaaaatgtttgcctattgctcttatgaggaaagaaattttgttcgtcaagtcttttctccttgaagaaatgtctctaaaaataatttatattggtattgatattactataatttcttttgatttagtttaggccaatttgaagctgatagtccaaagatatataatccctatgtaatatacacttagcattatcaaatcagaaccctgtgtttttccttgggatcaaggttgattgctgttcatatacgtcatgaaaacttccagtgtgtcttaaaactattaatttcatgttttacttgaaatctttctttataatacatgagaatgaaatagagatgacccattgcattcctcattatagtttcatcacaacctaagaaaaatttaattcatttatcctaccatcttaatatttacacacacacacacacacacgcacacaaagcctcataaagccagtagattataaaatattctgtaccatctagtgatctttttatggcaaaattcagcaactatatctataatttcatctcttttgtcaccttacctactgttgaatttctctgggtgtttttctctcatgatgtggaatctgtgtgcaatggaggcatcctaaggggagaaaatagaaaacaaaaacaggatggtttatgatcctattattttatgaaaatgtagactaaataaaaaaataacatttcaaaatgaacttttatttacaatattattgccaagaaggttatgtaaaattaggcaaaaatgtgtgatccatatgcagaagtgatttatgtaattctatgcagaagtgatttacgtaataatttcacaattgattatttgttacatttacatctaagactttattgctatttaatttctatatctcctttaatgactggctttggcctcatgttcaacgtatgttgaagatagcacatatgagtgtaaatgtcaaatagtaatggaaaatactgttaaacaagagttagaaggatgccctaagtggagaaatgatcagtacagaggctcctaattatttgagataattatgagtaaaaggatggtgtgagtgtgcatgtctagtaaagataagtgcaatacttgacttcagaatttgctcaggttgtcttgatgtgtaattaataacagtttggaccacaagcaactttctggcatagctcgttgaatagaaaaaaaaaacaacaacaaagagaaacatttatttttggggaattggtgacaaatacaatttgtttctgagaccccaagtgcatcggttctgaccctaatggatgtttcttacttttagcaaatacagaatttttccatgagatagaaatcatactcaatgtgtgagactgctgaaatactgctatccaagcttttcaagcacggactgctccaactgactctaaacaattatctctgttattccaagtgtggagatattttcccattcttcaaccacacatgattaatcactcaaatgaggaactaatatatttaccagtcatctcaacagaaaagggctattgttgacattcactgttaattttgtttcaaagtggagataaaagaaaaagaaaaccaaactcaaggaaataaagaagttgtgtatttgagagaatcttgaaaacactaatcaaggattaaaagtctaatgaatgaaatgaaaggctaatgtgcttactcatgcataacaaagcatgaagcacaaaaagagagggaccaatgcccactgcagatggcagagagttgcaggatacagctaactgtaattttttttctgtataaacatttgataccctaaaatttgtcaagtaattgaatgaatccatgaatgaaaatcacccagacatatagatagaggtgtatagaaacaatgcttataataaaggttacaaaaatccccctctacggtttaatatttaagacgttattttgttatatatacatggccaacttcctggtttgctaggaagtacaaatatcaagatggttcacttttattcgtccaacgataactctctaatctagtcacagagttcctttttataaatttaattctattaagtcataaacatattatactttataatatgaagttgtcttactgtggtatgagattacaggaaaaacacctgaactgggctatttatggtatatgtagcatgatcaattaattaattttgaaatgcacttacttttactttatccctaatctggtacaaaatcaacttggaataccttccaattaaaggcatacattcagcagactagttaaacaaagcaaaggaatatgaatcaaacactaagaatgaataatcaatattgcttcccatagggagagtatcattgaatttacttctgcttgaattgtttctgctaagttggggagactgagacttttaaaaatagattgtgtagtacaattttttttacaggtgtatatttttgtaatgacaaatttcttcctttacaaagcaacataaacagaatagagaaagggagagaggcaagaagacaggagggagaagagaggggagagacagcaaaagaccatttaagtagactagactataattgggtaaactcctagaaacacaggactacatagccaaagatagaactaatattagcttatttatcttcaagatacttgggcaatggatcatttagttaagaggggaaaaaataaaacttagtgtcaaacactagcaggtcttttccttgtgttgaataggttccaccataaaaagagaactggcattgccaactacaggattgataaggaacaatgacagcaggtgttcatttggatgagaattcagatccaattcacatgggaccctgtccctttggcataaccccaaagggcttgatagagtactgccaaaatctgcaacactatccagcagccatttttcaagagacaccaaaggttctctaaagacagccaaataagaaaaagctaaaatgccattttaaaataaattttaccatttctgtctgaatgcattacagtttttagacaacagaaataaatcagcattacttccgcttcctagaaggcacaaactctgaattcagactttctacttccaagccttgtgacttcaaacaaattatttattcattgagaaccacaacttccttatctttaaaagaggatactgacatcccttcaaagtaccttggtggagatttaatatcattctctatagcaattggaacagtattctatatagctcatattttcatacatcttatatacaaaccagtattttcttaaagttaaatgagaatgctaaatatggttaaatgacatatttttgaaatatatttttaaagacttacattgctttttattatttccttaacctatatagctttatttttaattaattaaaaaaatctaagaaatgaaaataagtcaatcttattaaagcaaaacaaatttaaacctcattgtgttattcaaacagtaaaaatgtaattagcaacttttcttgctacgtgtacatatataagtatatgcaaatatatgtatatagaataatcagcttattagccatatgtgtctcaaatacttgatcactagtatttttctgaaatgtatttttcctttttctgtataggcttatttatgttttaagtaaaattgccctaaatctccaaatttgcattttatgatattaatttgaaaagctgaatattttctatggatcataacattttcaattgagagaatgttctatatgtattgagatcccagagcctatagcaaattctgctgaggagaatattgtctttataaaatgtaaaatagaggtacccaaatattgtcatcaatattatcttttattctgtttaaataatctttctctcacaaatagtttctaaaatttgtcgagtaaattgttcatttttgatgatttgaccattgcaccacattaaatatcttttcaatttttttccattttagaatagaatataaatttagccaattagaaatgagtgtcatcaagagttattccaaaatctaattttagaattaaaagtaatcttgcatactatatgggtttttattgttgaaataatttagttcttccttgtttttggaggaatgaattccaatctctccctgtgtgcaaacttttctttttctcaaaaattgtaatttactaaaaagtttcaaaagctggttttcggtgctgtatttgttgaatattttgttaaagatttccagtaatatttttggagtgttactgcaaacaagaaaattgccaattttaagtgtatacttcaaaaagttttgtcaaaggtacacaataacaacaatcttttcctatgcttttgttcattcatatttcttcttatgtggactacatattgaagtctgtgtccatttatctctgtatattaaattgactgggttcaagacccagctctaaattttactgaatattttactttgaaaagtttgcttagattttcattattgtcattttcctatattaaaataagaataattttaataatacctgccttgctttgaagatctggtgttctaatacctggaagataactagaattgtgcctggtgtatagaaagcaagaaaataaatgttaactattactattactgaaaaatattcatgattttgagattcataataccttctcctttggtttattgagatggttaattaaataaattgcataatctttaagatgaagtatatgaggaaatttttgctttggtattcagaattttttgggttatgcattcatatatgataaattatctaacaaactcaaaagggtgaggaatatcacactatacttaaacttcacataaatatttctgcactagtacatatgaatattaactcaaggaaagataaattaacaatgtgagatagagctaactgtaattacagttatactagaaacactacactttgtaataccacaaagagcagcttagttcaggttatagttctcactaagaaactataaaaatctgggttttcaaagctttgttagattgagcttttaggtaagagattgtggttctgtatttcccatctggaataaaacaatgtttgctctcctgatagtgtttacctgaatgtactatgctctcctgacaatcattacctgaatatactatgtatataaggcactattttcacctgttaatatttttaaagaaaattacaataatagccacaagtgggattatttcccaggcagactgtatcagatattgatatctgtagtgctgggttgattaaatagagccagaaggttttcttctttatgctgcagaatagttaataatgcatgggaattatttgttctttaatcatctgtgaaatgttggcctggcatttttttttttggagaagttaacgttttggttttcttaatttctctgctatattagtttttctatctcttcataaattatgttttttattacatcatctgtagtgggctcaatggtgccccccaaaaagatatcagatcctaataactggaacctggtaactttttttacagaagtgaccaagttgatgattgatatcgattggaaccagtgacccctctctacattgcactttctttttgcgggaataggaatgcgtacaactgtgatactatgcttttttgccactgtattttgaaagcacataacttgttttctactttaacatgtccacaaatggagagatattttacctgaagatggatgatactaagtgtcatctgtatctgatttaggttatttacatgatgagctttgagacttggagctgaagatatttagatcagattttctacttaagttgatgacgtaaaggactgagccatttggggatatcaagaagaggtaaatgtattttgcacacagacatgaatctttgggggccagaggacagttagcagtgggatgactgtgatccctaaacatatcaggtcctaatctctagaaccttgaaatgttacctttgatggtaaaggtttttgaaaatatgattaataatttggtgatgagaagattatccaggtgggacgtaattcccttcacaatttccttatgagagagagacagagattagacaggaggagacgatgcgactacaaaggcagacattggagtggtgcagccacaacttaaagaatgctgaaagccaccagaagccaagagccacaagaaatgttttgttctccatcacctctggagggagcataaacctaggagcacctcgattttagtccaaggatattaaatttggatttatcatctcttgaactgtgagacaatacatttctgttgttataagtcaacaggtttgtggtaatttgttacagcaggcatgggaaacttatacttcatctgttcatgtagggtttttttttttttgagaaaaacattattctataatattttaattctttcttgaatccatggttattttgatcctcttaatttgaatttgcattatttttgtatttaacacacagtttagaatctataacttagcaaaaaggcataagagcacattagaataggcatagcaaagcctatatatatgtcaactccacaaagttgacacacaacaaccaaacagtaaaactctagaggtaaaaattgttgttttgaaaagaaggatttattttaacgcgacaatatagtgtagatgttttcccctctgaacatcatgttgaattgtggtacccagtgttggaggtggggcctcgtgggaggaaattagatcatgggggcagatttcttatgagtgcttcagcaccgtctccttggtgttgccacaatgggtgagttctcatgagatctggcttcctaaagtgtgtggcatctccccccacctcttgctcctgctattgccatgtgaggcacctgttgcccctttgctttccgccatgattgtaagcttcctcaggcttcaacagaagcttaagctggtgctatgcttgctgtacagtctgcagaaccttgagccaattaaatctcttttcttagaaattacccagcctcaggtgtttctttacagcaagcaagaatggcctaacacaccccagatagcactgctgagtatctatttaagattgtatgtgcgatctttagaaatataacacatcaagaattagacaataaaagttacatgtatcataaagaaaaagaaaggctatcattatttatacatgatataatgttatatacagcaaattcaaagaaataaactgaaatccacataaattgggagaagagtttaaagtttcccagatataggagtagtatataacaattagtggaattgacaacattaaaacaaagtaacagaaaaataataccatttacaatggcaaaagtaattataaatatataggtaaaaagtctgttaatctgagtcctatggggaaaaatgataattactgaaagacacacacacaccacacacacacacacacacacacacacacacacacacacaatcagtggagatacacactatcctgagttacaaagatttagggagttgatgttacagtgtctgaggaatgatacaagctcttctaaatgcgagcacaggtagcagcacctggactttactctgctagattgcattttttgtcttttagaactaatgctcatgaggtgtgtgtgtgtgtgtgtgtgtgtgtgtgtgtgtgattcgacaggaactcagatgcattatgatgcacatctgcaattttgcctgctgtgaatacttcagatggaacccattgtagatttctgttacttagttttggattacactgctggaacaaccagggcatttttctagaatgaaataacttagagacttggagaaatacatgattgagagcaagttaatgggatttagaataaagcaaatccctagagtaggatataggatttgctgaatggtacatgaaaattcaaaagcagattttaaatagggacacctggccgggtgcggtggctcacgcctgtaatcccagcactttgggagactgagacaggcagatcacttgagaccagcctggccaacatggtgaaaccccatctctactaaaaatacagaaaaaaaaaaatacccgggcatggtagtgggcacctgtaatcccagctactgggaggctgaggcaggagaatcatttgaacccaggaggcggaggttgcagtgggctaagactgcgccattgcactctggcctgggtaacaagaataaaactccatctcaaaaaaaaaaaaaaaatagggacacctttgtatgaaggtggctgcacccgtgagcaggttccaagtgaattatttaatttcttgggtatttgatattaggtgatggcaaaatttataattagaatccagttcaagttattaatctcaaactttacaatccacttcattcttttttttaaaaaataattattccataaagttggacatggtcatatcactcttgtgattatgttgcagagggcagtgatacctgggttatctgtgagataaggcctgccttacttcagcattttcccattgtccctcccattcaggaagggccccttgggaaagtagtagctatacactgggagaaggggcagcatcattgttccatcaaaaacagatggtggcctctaatctgaagaagtgccctattgtaattggaggaaagtttactctttttaaatgactaccaaaaagtctgtgggaaaccacataggatcatgcagaatactggggtaggtaaaacactcgtatgtccaaagggacaatgtgaggagctagttaccagacccagagggaaagagttatatagagaaaacggccttgggaggaaaagacatccagccccaggtgacattttcaccgaggtatccaggaacgtaagaacctgaaccctgctttatatcctctcatctactgtggggatctcaactggccaactccactagaagaaagagggcaagggaactttgctgtcttctatacaggacatttctcaggcagacagcagaacgaacaagggcagagagaatatctagagaggcaaacagaagcacccagaacacagggaccacagtccttgagattcaatgcttatggtagaatggagagctgtgtgtgcacagaagtctaaaaagcaccagtaccaaatctatggtaaagtattgacaattattaattaaggtgaccaccggagtatcagtataaattgttttatattttccactatacattatgcattaaacatttacatttaaacttcaacaatttagattaaaaatatttcattaaatctatagatttaatttaactgaagtaaaagattaatcttttgtcttattaaaattgatacgtagcatcacctttaaccttttcataatggcaagagtcatcttgttaagtaacacatgccacgtaccgtggtgggcagagtgtgtagggctattcactttccatgaaatgactccagactgccgagtggtagttgtgccttgtaatcgtttctggatttttaacttatttcctcttccaccacattagactgttaacattctaatatgttaaattctaacatgctgcaaacaacacgcctgtccctagcagtttcctccggtttgcttgattttaattttcatgtgttgaaaagaaatgaaaccttagaattttaaatttagaattgaccttaaataatgctcataggttagactagtaaagtggttttaaaaaagccaagatgaatctagaataggaccaataagcataaaaggagctggattaaatctctgtggacttctaccataagtgaatgttagtaattttctatgtgaactttaagttaatcattgtaactatttctaaatatttaattatgcctactgcctagatttccattttactccaaaaagtcaaagttcttaagaaaattccttttttttttttttttttggagacagaatctctccctgtcaccaaggctggagtgcagtggtgacattggctgcagtgcagtgcaatagctcactgcagccttgaactcctgggctccagtgatcctcttgccttgacccctcgagtaagctgggattacaggcattagctatcatgcctgactaacttttttttttttttctttagagatgagagatgaggtcaagctatgttgtccaggctactctccaactcctggcctcaagtgattctcctacttcagcctccaaaagtgttggaattaacaggtgtgaggcaatgtgcctggcaaaaatgacctttgacaaatcaattattattggaaataaaatatatttctcatctgctgtaaataaaaacttatgaacattgtaatggaatatgacaggattgaaagcaaatgtacaaatgattactatgagtctcaattccaaaacagaaacccatgactacagctagggaaccagatgaagagattttaattaagttttaataatcttactgagaatttctctaggttacaaatatttcatacagaagagttcatgaaattgggcagactaattcaaaatatgaaaaaaattgacctcagagaatctagagacaacttccaagaagagaatataaattataaatcccactcttgctctttcctgcgtacaatatgtagcattagcaatgccagaaaacgtctgtaatggtcttttcacataattaactgtaagcttcagaaacaaacttgtagaaagaataaacttactatacacttactataaccacagatatatcatttctgtgattaaaatgctcccttaaatacaaagtttcttctaccaagcaaattccagactcatttttaatggattaaagagatggaatttctctcaaggcgtttattttaaatctctagatttaggccaggtgcagtggctcacgcctgttatcccagcactttgggaggctgaggtgggcagatcacctgaggtcaggagttcgagaccaacatggtgaagccccatttccactaaaaaaaaaaaaaaaagtatatatataaaattagctcggtgtggtggcacgcacctgtagtcccagctactcgggaggctgaggcaggagaatcgcttgaactcaggaggaggagattgcagtgagccgagactgcgccactgcactccatccaaacggggtgacagagcaagactccgtctccaaaaaaaaacaaaaaaaaacaaaaaaaacccaacaacaacaacaacaacaacaaaaattattttctagaaatctaaacaacaaaaattaggtctagaaatctaaaatgaagaaaattgtaaagagcatacaatcagcaactgaattaaaagtgtaatccaacatgtcactgaagaaacaaatcatctgtgtcttaacatagaattaatctacttccctaagtgtcacctgacaagaaaatacttaacaaaaatctttactaagatgatcataggcctagaatatttcacaaactctgcctgtatctattgaataatgtagggttccagtgtgttttggtctccctctaatagaatccttatttcatagtttccattcctctttcccaattagaaaacaatgacaggtatataaacttatatagctaagatatttactataatcatttgattgagattttgaattgagaaatcaagtcaatgtaatatatttaaaactgttcatttcacagtaaattagatatttaactctgttttagtttctggaaaccctaagtgtttttgctgatatatattattttcaataatcaagatatctttctcagttaaggcacaaaggttgtatccatcaattacatttatatgtctcaggttgattggtcattacagtattcattcaatctgataaaagctgcaaatgtgttcagtgatttgatataatttccgaaaatctgcaaagaaagacttatcatctttgaatacccaagggtttgaaatgtgacagcataatacttaattttgcaaaataaatccaagtcaaaacctcatgtgcgtttgcaatcattaaactgaagtggggaatgaccaaagcggtatgagtggtcaccagtaacttgggatgagatgggagagtaagaggtagggatacaggcagcagtggagcctgaagtggacacaaaggaggaggggaaatgagatagaagaaaaatcatgtttactatctacaagtaggaatgagaatagatctcaaaggcgcgggaggatataagcctgcaattgaggctaaggggtcccttgagaattatactgggacagagagaagggagctggatagtgtggtggaaccagaactagaaataatataactttcacggcaaaagtctgaaagtaaggttctctataacattcattaactcaagaacgccaacagtatcgatgctgcaccaagaacagagtgcaaagtacaattatatagtttttaatcccatttaatttccttagtgagtcaatgaggtaaatattgttctagagaaaaagctgaaacttaattggtttacataactcagcaaaaatcaagttaaggtagccaaaacttaaaccagaatatatgtaactatatgtaaatagcacatagttacatagtctactatctcaaaaggctttagcttatgaattccaaagagaatcaagctttattataagaataatttccaaaatataattattttctttatacctgaaagacaattatcttaataatttggttaatttcaattagatatctcaaagtgacagcatagtttatttatttgcatctcatttcatctaggcagccacgtgcccagctaataaacaaatacattctgattttcctgggtacctttgtaactagaaatggttatctagacagaggtccattccacccttcattaccaccaccttactcacagaaatgtggatttaattcctgaaagttgaaaagggggacaaaaaggagtccagtcctttaaaacaacttgaagctgtcctactggctttgaactaacttcttccagttgtcctgggaaaagaagcctatgacttagaactttgttattgttccataaagccaattacgatcctaattgaaacaaaggtaatcatttattcagcgcttcattcctgtgagaacataaaattagggagtcagtgaattctgtaatggcgatttctacaaaatatttcactcaattatttttctttagagacaaaatgacaaaactttgtatttatatagagctgtgtgatttccaaaggattttctggtaaattattcattttgacctgattaattgtggtaattttttttttttaatgcagaaacaggagagatgctaatgtttgccctttagaaagaatagatctgagtttaaggggctttctagagattatgcagctccctagaagtgagaatgagtttagtctttaaactctcaatccatgactcatggtgctacttccatattgatatggtttggctgtgtccccacccaaatctcatcctgaattttagttcccataattcccatgtgttatgagagggagcagatgggagataatttaatcatgggggctttttcccctatattgtcctcatgtagtgaataaatctcatgagatctgatggttttttaaggggaaactcctttcacttggctctcatattctctctcttgtctgctgccatgtaagatgtgccttttaccttctgtcatgattgtgagatcttcccaggcacgtggaactgtgaatccattaaatctctttttctttataaattacccagtctcaggtatgtctttatttgcagcatggaaatggactaatacccatcttgtcaagcaatatggattactggataattcacttgatgttaattttcatgaagaaccacttctgcttttctctaaggtatttcatcatttattgttgctaatgccattagcatccaatatttcctaaaagaacacatattattcagaaatttagaggctgcttgtgtccataattctattcttaacataatggtaggttttatttaattaacgatttagttcctggaggatgttaaaaaacaaaatatcgttgattgattctttttaaatgataaataacatttgtcctcattctttgttctcaagaataatattattttaactgtcctttattgtaatcatagtaattaaagagaatcaaatcagtaaattaatagcttaaaaccatgagagactcataatttatctaacttgttagaaaaattgagtccaacatccctcagcaaaaatatctcatacctcagtgctacaaagaacattgtaaaaagtgactgcagaactcccataacactaaactagtatttgaaagagaatataggcctattacattatccttataaatgattaatttttaattcataaaagtttacagagataaaagtgttttgtttataatgtaatataaaaattaaaatctattgtgtatctagaaaaaaattctagacataaaacctataaggggaaattgctcctgttaatctttgcttttattaccccaaaacagggctataactagtctattgaggactttcctatgggcagtagagaaaggaacaataatgtgaacaggttttatgtactgcagaaggatcaaatcttgttgagggagtgaggaggtagctattgtctagggtggggggtgatggctggagttgaaagccctgagggaaaatttaaaaataccaataaaagaacatatataagatattgcattggtggcacttaaaatatttgctcatgtttttccaacctaaaaacaaaggtctagtcttcatgcaaggaaaattatccatattttggattgtttgaagaaaagaaaatacaattgacacatttgttagtgaggtacagcttacagggattcacagaattaatgggtattagatgtaatactttaatctctgttttctgcaaatcatgaacccccgccatgatgggtttctacagttctagacctgatgtatttctaggtctgacctttatgccaccataaagtaatttaacaaacacctctaaaaataaaagacatggttcacctcaaaaataataagggccaagaaatttaaatccttttgatagcttacattcaatagcaataacaactcaatacaattacacatttaaagtacatgacaaaaaagggttaaactttaatggattgaaagaaatattttaattatactgtttgtaggctgtcataaatagtaatagccatagtcaaattttgcaaacatggaactatccctgtatgcttacatagacataaccatttttcaatacatctactttgaatgcttaatctatgcaaactttcagaggcatatttgcctagtgttagtatttctgataaaatagttttatgttagtttccagcaaaatggttctctaattaggcaagtatatgtggtcaattatgtttatttgaataaactatggattgaaaatggagttttatgttctactctgctatttgaagactaaaaggaagagatggtgatgcttgatgaaacaatggatgctaataccatgttttccccttatctacagggtatacattctaagactctcagtagatgcctgaaactgcagatagtacagaaccgtgtatataagtatatatatggttttcccttacatatgtacatacctatgataaagtttaaattagaaattaggtacagtaaataataacaataactaataataaaatagaacaattatcacatatactgtaataaaagttacgtgaatgtggtgtttatctctcccaaaatattttcttgtactgtagtcaccctacttcttgggatgaaacaagatgatatgaagcttacaggatgagacaaagtgaagtgaataggcactgtgaatgtagcattaggctacgagtgacctaagtggcaggtagcatattcaacgtggattccctggacaaagggatgattcaagacctgggtggggaggtccagggacggtccaagatttcatcatgctactagaacagtgtgcaatttaaaacatataaattgtttatttctggaatatttgattaatatttcagactatggttgactgcagtaactgaaaccgtggaaagcacaaccacagataaaggggactactgtaatattaagcattctacatttctggacttatccagcatgtaaacttctcacatataaaaaagtcatcataaaataccatggctatcatggtatcatacacacacacacacacacacacacacacacacacacatctatgtacacatcatagcaattaaactgaaatgtgatgttaatcatatgccatatccaatataaaatctataattacatgtatggccaaaatgctccacgttattttggcaccgatgtattagcttcaatgtttcaagctctttgaaggtttaaaatatatgaaaatgctctgcatattaaattcttttaaaggcccccttgttcaggaaagtacataatcaaaatatattgtcttatggaagtattccttaaaagagtatattttctatgatattaacttagtagtcaagtattagtattagttcatttcttatctagcattttatcttttatattcatatagtattttaattttagaattttataaaatgagattttagatgcctaacaaaatgtataagcatcttgagacaatctacacttagtgattcaaacgggacacttttttctgtattgtgctaatcttaatttgtgaccctacccaccaaaagaaataaaaagcagtctttgcaaatataagaatacaaatttagcctaccatttttcatcttttcaaataagcagtatttatgggttaaccacacttatggcttaatatggcattcacttattaagaatgataaccaccttaaattagtctcacaaacaaaatattatgggacaccttgtattgcaatgttttgccaggcaaaaacatcactcattctctgacatcaaatatgcaaagtgaatagaaggttgaaagcgcctatgactttttaaaggtattcaaaattacacatttgtaaaacactgctttgcttccatgatttagttaaatcattttatgtatttcaaattgtatgtctttgtttcactctaacgtgaaatttaaaaaaatacatacacttgaccagtatctagtcctactaatatatacaatccacgtggatctgcatgttatatggcttcatgataaaacagtaaactatcttcacaagattagtaatactattttttaaatgtcttcaagaaagacaaaggtttaataggctaaatttgatagtattgttgatatccagcagaatcaaattatttattttctgttgcttaaatgaaaagtacaaatatattcctattgtatttcaagttgacccatgattctctagatgtagtccccactaatcagtggcaccactgaattcagagacaaatccttcctgatacacacaatggaaaatactttaataagtgaacacataagaatctataatactattgcacaaagagaataatggtcaacaaatggctcttttaaaatgcattatttgtcactaaatacactgccattataacaagaaaccttttgtgctttaaaagggtatgtttctcagtaaaatatttatgcttttagaaattaccagactatatagcccctgcacaacaatttcactgttattacacaaaattgtaaattatttctttttaaattattaatgcaattgaaaaaagaagttttcaggcttatagtcttttgaaaggacagcaaaatagacgaaacaaaaccaagatgacaatttcagcatttaaaatctacacatgataattcaaacaaatgttatgacatttaagataatgaaacccttcatttattctactatctggtatgagttttatttcacatataaggagtcagaacagatgtccaaatattgtaatgccaaaagaaagttagggcatatcttgattaataccctcagagctgcctgtagtgtctctttaaaactggcatggtttacttcaaaacaactattcaaaatccattctaggaagcctagctagacaaagattcccaagacaaaacgaaaacaataaagcttagtataacccttttagcaatgtgagttgcgtattattgacagaacattcattgcaatcagtaaatgattaattgcaaatttgttgctaaattgaccacacaaaaaaaagagacaagcttcaggctactgttaaagaggaaaaacttatgttaaaaattattggaggcttcttgtagtgaattaattctaatcaatatactttttgactacacagtggaataatgacttccttaaatatcagaggtacccattattgtagacattcaaattaataattaacatactgacttgcatttttaaaaaatttacggaagtagctttttcttttgccttacctttaacaaataaatagttcatgtttcatcaaacatgtgcataagatttgtttttgaatttcaaatgtagattgtagaagtaatgcccatatggtcaaacttataataattgcctgaagcaatttgttcttgggtttttatgaagataaacctcagtggcatattaaaaatataaaagtttaaaaggtggtaagatagatggatgggtatttgtttctcagttacaaatggctatgctttacaaaaatggtgccttttgggttcttttattcatatcagaatgatcaagcaaaaatgagtggtataagggtacaatataatattttgcacaaaagcaacattttcatcaaaataacctgcaaagtcattttcagaatatttattgagcacctattgtatgccaaacactgtgctaggttctgaaaagacaaaaattaaataaaacatagaacttctgttaggcaaataatatttgtaaatctcttcttcccttaactactcatttttctttgaaacttattggaaatgcatcagtgacaaagaggcagaaacattattctaaagtttttgaaaacagaagcaataacttttgctacaaagatgaaaacagaggataaataaagctgcttcagatatttataataatttgatgactaaaaaattatgtcagtgattatgtagtcctatttctaggtaaggtatccaaagtcactacagctaataaggatatatttctaaaaattatgtgagggtgcttcaaggtctatattgaaggaggtggggaagtggtaagaaaagtgcacatctttaaaatgtggtataatatatacaatggaatactactcagccataaacaaatgaaataatgtcttttgcagcaacttggatggaactgcaggccactattctaagtgaagtaactcagaaatcaaaaaccaaatacgcatgttcttatttataagtgggaggtaagctatgggtacacaaaggcatacagagtagtatattggacattggagactcagaagcggggagaaagaaagggggaaaaggaatgaaaaaatgcctattgcatatgatgtaaactattagggtgatgggtgcactaaaatcctagacttcaccactgtacaattcacccacataacgaaaaactacttgtacttctaaagagattaaaataaaaattttaaaataaaacataagaaatgttttaaaaaaagaaaagtgaacatctttggtttctacagtagccctctatattgagactgtgttatacttttgggatgactttacaaagaactatgaagtccatccccccatatcataagatgccttccttagctctatgttcctaggctctcctaatggtattaaacaatcatgtccctatattcctcagtgtgctttcagccaggcataaatgaccataaatagcctctgctgcataatccagagcaccaaatggcctggagctagcagacaagaattcgaactttgctgcatcaccccaaataacaataattcactaagttattgaatgttgtatgttattatgcagagagtgaacaaactgacattcagcaatgctagataatttgtgcaatactgcaaaaccaataggtgggttcagctggtatttgaacacagctcaattgcttccttctgttctaggagatggcttgttatcttatttccacaatacccactgaatattgaaaaaaattcctttatataaccaagtgacactcatggaaggacagctcattttctagcactcaaagcatacgttttgttgtacatttaactttattgacacaaagatgcatttaatatattcttatttatggattatgttccatttttgagttagattcttaactgttataatacatggggaatatccatgctttattgtatctgagagttttaagtatagaaatatttttcacttaaaaaggtatgtaatttatatctatttctgcttaatttgtgaaaacaatcttttaaagcaaacaataattgtcctagtgaagcaaatttgccaccttacacattctccttaatagcatttgttgatttgttgaagatgcttaccttgctcaaatctgtttaaatctcattaaaatatattcacaaacaagtgctccatttttaaaattgctctgctaaggatacattaatacagtcaacttaattaacacaaagtattatacaatcataatgatacaaatttaaaaggaaaatggaataggtaaaaagtcatcaaattttaaaaacttgagtgatctgtagaaagtcaagaccagagattcagagaataaaataacctgtctaaatgttaatgctgaacaggagtagaactaaagtgttctgaattaaaatgcaggcatccttttcgattttatgattaatcatcagaattaaagtcaattgaaggtaattttggggaattgctaatttagttgatttttttgccttgaagtttacagcattctgtcaaagcatgctataatgtatccagtagtagtagtacactttttgttaggaaggaaaagagaatccaactaatttgtattttgcaatgagtaaatattaattccaacagaataacaatgtcaaaattaccaattaccttatacagcaatatagtttatttacttgcggtaagtttaccaattgctcacataagggaaatagattatatttggtaaggaaggtcaagagagaggaatcacttggagatgggctggaaactgggttttgaggatgaagaaaagacattgtgtgtaaacatgaaggattttgaaagtatgaaggtaaagagttttaatttcatttcattgggaagtttagtcctctgaattaaaaattcttgaacagaggtagagaaaaggtgtttcttagagatgggcatcattctaaaaagataactctgtggttcggtttttgagttattattattattttataaatgataaattttgcactggttgcttgagtagtaaaatgtagcaaatagtcccaaacttctatatgtttaaaattattttctgccccttttactgctttttgcccagaaagataactaagtttgttctgggctggtatctaggagttaatatcatttattattattgcttgaggctgagacttaacaactttggcaggaagcaagtcttcatttgatttgaaaaatatggttaattttgcagtatgttttgctcattcagaataattcttcaaaagaaatatgggtgagtatttgctagcatgatccacaaaaacattattggctatcacccccgaaagattagttttggtttgatttctctcccttctggcttaagtcttcttgaataccaaaagttagaaggaagacatggcagatcagtgatagattatcataatcataaaatcacaaaggtggagcctcacagatcatcttgtttgaaaattctttttacaagcaaggaaactgaggcaacaccttaaatggaatgatttacaaataatgagctggtggcagagctatggctcatgattcctagtacataacctttatactacataaactaacgttaatatcaagtagtggagaaatcaaatattcttctgaaacgtaaatgacagaaattgctcaaagcatagcctagtgtagtaagataaaggaaagaatgattaaatattttccaaatgtggaaacaaaaaacataagaactgtcatagtgaatcagacccgtggctcatcccagcgttttcttttaggcattggctttgagaagagaatacatttcttttcccacaggtcaacttcaaatgttagaaattcaaataagttgaaccaggactactataacctaaacaggttattttcccttgtggagttaatattcacaaattcgttctggcctttttcaatactttacatatttttatgttccctaattttatatgctccataacattttaaaacttttaaatattttatttgctgtaaatccatgctaacttttaaaaataaaacaatatcctccttttctcgtagtctaaattttattaacatctttgccctttaactgtattgatccagactataagttttcttaaacttcacctttttgataaaagaacaaagtgttttcaaattatttttattgatcagccttttaaataaaattattttacctttatcagcatttaaaaataggtattttttattatgaatttgtttattcattgaacccttattctatgtttagtactggagtaagggtttaagataagaaaatgaaccaaactaaaaagtttctttatttttttttttgctatcatctttcctaaaatagtacaatcaagagtacaagtttatttcaagtagcatttccatatatttggtaaaaatctttctacctccatgtttttaatttcactattattattaaccataaaaaataaaaagtaaataatacctacaggtattactcctacaggtaagcagtctcgtggtgttttaagcatggtgcctggtagttgggtgtgaaattggattcggtactaggtgattgatagaagctcaaaggaccttatggagtctactggtgaagatttgaaggacagtgagaaaagtgttatcgagggctagaagaaacaggacaactgttgtatagcggtgaaatatttagcaacattcttgcttctttttacatgaaaaatataaaagatatctataaatatgacaacggctgtaaacatttctaggcaaaatgtagaaaagtgttcagacatattctagctgcatataataataaacgggacaagaataaaggaatttaaagttttaaggcaaaatttacagaaaatattaataagcttgatgagtttgaggataaaactatttctcatcctgagatactcccagaaaaaatattctcaagataagaattggcttcagggaaaaaatcaaatccagtgtactaccaataacatggtgggatctagggttataggaatcacaaggttgtgactgtatgatttttgttaaaaccttaaaaatatttaagggcctgcccaggaaggcttctagaactcttaagagaatgctttatagacggattcaattaatagggatcttcttaaggacagtgtcccaaagtagcatctcaagttaaagaaatatcatcaggaggaggtatatggttatggcttttgtctgattgagcaacttataatttaatacataagaaacatacaaagtttttaaaggaatgcttatagtttggctaaaagtgatagaaacagtacaaaatgaaaagaggttgttgaacctccaacctactgtgagaaggcagcaggtggagaaacttgcttaatgaaaaacacaaatatgtgtctctggaaaagaggtaatgactcaaacagaagaatcaagagctcagagaatcatctccaggaagctgaactgagttaaaaacaagaaactggcaatacgtgttctgctggatttcataattgctatgaacaaatgactgctgtgtattttgtgtttccttacttttcgaatgggagtgtctattgccattatcctatgtcattttatgttggatgtatatatggggtgcagataatttgtttctttagttaataggtttttatttcaagatgaactatattcaaggagctgtacctgaggaagtacactcaggaaccccatctatatcctgacccgatttaaataatggggtctggacttcgaacaaataccataatgggatgaggtttttgagggtcttggaagatggtgagtatattttgcatgtgggattgcaatatatttttgggttaagagggtggacattgtagcttgtctcaatagtagctgccattatttttttccctacttgttcacacatgtcataccccagtgaaagaggaagtctatttatcttaatgtcttggatgtgggcttgactaacagaatgtgatgaaagtgacattctaggcattgaagctttcacctgtttctcttggaaagcttgttttggaaaaaaccagctttcacataagaagtccaactaatctgttaccttcatgttttgagatgagaaagaagccttctcctggagagagagaagtcaggtagaaccaaggtactaggcatgtgagttaagaaaatattttagaattttatccccaaccccagctgccagagctaatgcccatgaatcaaagaaaaaaacatccagctatgcactttccaaattctccccctacaaaattgtgagtaaaataaaatggctgtttaaagccattacactttgaagtcacatgttacacaatatacaactcttaagtaaaccaaacacaactatactatcatttcaggattcatttataattctgaagtacttttggcaataattagttttctggtgggaaaatattatgtttacaagttggagtcttaaatgtagttgatagaaatatagagatcgcaaattttgacattagattggaaacttaaattgaggcctgatttagattatacataaagtatctatatgcataatccttaaaaatatgatgtaatctatataacactattctcttcacagagcaccccaactgcaaaagcactcttgctgtatgcactgatcattcaaatcccatcacaatttctatctcctttgaaataaacatagctaggattctggctttcaacattcctttcccattcacctactcctctcatcttcaacactttccaatcttcccctaaaggatcagtttacttacagaaaactggaatcaacaaaagaaccactagacagcttaacatttgagaggactagctctttctttgactttctgccttcactccagtaactgtttttctcccttgtgatttatgcctctccagaatctaatttctgtaaaatatctgcgtgcttgtgcttctaccattttttgttgctcaattgctcaaaaaatatgtttcttacctatttcaacatgtgtgtaagatctactgctgaatctacctgatattaatttttcttacagagacaataaagctttaagtttgtaagtttttagacagtttggtaagacgttattcttaaaactcttttgaaaaactaactccacatttgtgtgtctgtcatctccaagactagtcaatccctgcctatcacattttcccaaagaggagatggtcatttgaacagactgctttctctcttctataacactgcatgaattacttctattaccttattttttacctattttaaatttatatcatgatctatattttgactcatctttacttaatataaaatgttaatcatttaattatattgggagtacccttgaggcaataatagattcttatctttttatggaagtggttttaaaaaattgtagaaataaaaaggtggttttcaacaaatagtataaataagattaactccgagatttattctatgggtctgagatgaggctaagaatctgcatttcacttactttaggattccaattgtttctggtgcagatggccaaagactatacaacaaaatgctgctttagacaatagggatgtgatttaagacaatttcctatagtaatgtaaggcagcgagtgactaaagggcagagtccagttagaaaacctttgcagaagtccagagaagatatcaggagagggctgatctacacagaagcattagcaatagaaaggaggggacagatggaagctaaactagctattaacaagttcctgaaactgttttctattaaagctgccttagaaaatgaaaatgtactgtgtaagcactaaaacaaacacaaccaaaaagatgttttcttaactgggaaattatgatgtgcagttatgtttggtatctaaatgcaaattttgcatgtaggctgcatttatggaagaactgaaaacaaccacaatacactatatcatagtagaaacaaaacagactagctgtacttggcatagtaatgataagccctttaaattaaatctttatgcagattctattttatactccaaacttttcatggagccttgtgtaattctgatgtgtaaaccaacaaacagagaggctctgtgtatggagtagctggtttggataccagctggcttggctgtgcgcctttctaatggtaatgaagtcacacagctgctaggacaatcagctggagttcagattgtcactagctaaatggatatccattgactagcttcttatccggactcattaaagtttagtattgacaaatagtggctggaggtttacaactaagaggcatgtagaaatgaacttgttgactattttttccctatagcttttgctttgtgattcacagaatgtcattcatctgcttgagatgcatgattactaatgcactgtaaaattttaagcactcttctgcttataattttcaaagtgaatgaatgttctgaagcaagtagtcacaggcatcaataagttgtcagtatatgaaaacacaaagaacaatcagaaagtactatttttctttaaaacaaataaaaagaaggtatgatttgcacaaaaagtttataacttgaggttgatttttattttaaatattcttataggtattttactggataatttctaagagttgactgcatctacactagtcaacatgccactaaatactagatgatttcttttaaccaagcaaattggatagataagaatagtcactggtaattttgttaattcgatagtcatctcttgaacatgctaacacttttccaaatcctcaaaggaacaagagccagaaatcaacacctgttgggtcagaagtgaagaataagccttcatgttgataaagctctacggtgctatctcttaacccctggcctcactgaaggcatagagcttagatataatgttccattccttgtcctcatatcctatgcagtttgtgttcttaagaacatgttttgtcttgtttcaagaatagactaaacttggccagctgcagtggcttacacctgtaatcctaccactttggtaggccaaggctggcagatcaactgaaatcaggagtttgagactagcctggccaacacagtgaaaccccatctctactaaaaatacaaaaattagctgggcgtgttggcacacatgctaatcccagctactcaggaggctgaggccagagaattggttgagcccaggaggcagaggttgcagtgagcagagattgtgccactgcagcccagtctgggagacagagtgagactccgtctcgaaaaaaaaaaaaagaaaaagaaaaaataaattcaaacttacttccccactcattgtcattacagactcacttctacctttcacaactttgctgccttgtgaaggttttgaaaacactggatccatgctacccatgttttgcctccaaagaccaatgtaaaattgcctcctgactgtgtgtgtgtataattatctgccttagactatgatgacacctttaggctctttgtgaactagaaaaataaaaagttagcagaccttcctcaagaagatatggaagtagaaaatgctagagcaatacaaaatgtgaatgacgctcaaacgccagtaatttgcttctttaccatgtcctcatgtgtaaattctctttccctttccttgatctacaggacacttgcttactttccaggtctctttcctgtggattccaaaggcagggcaacattcttccattgtcagtagtgtaataaaaaatgttctcatttttattcatacccagatttttttttataattctgcctaatatcgtcaagtgtaagtaatacaaagcaggcctatggcattcattgttaaatgtatactctctagctcacaatgtgaaccacaaaaaataatccagttgtggattccagctgtttctagtgcaaatggccaaagactacaacaaaacacttcactagacacgatgactaaccactcttcctggtaactcagaataaagattttggcaaaattttctgattagagtataaaatttcatgcctcccacaaatcaatagatgtaaactcacccacataaaggatgttgtcttgactcaacagagcaagcttagtgcaagtccagaccttcatatgatgtaaaagtttttgtaaggcaaaatggaaaattcctacagttaaaaacttttgcttaatcatgttttaaacttcttaaagagaaaaaaatagactatgtagctataaaacatttattaaaaaaaggtagacaatatgcaaataaagtttctgtacactggcagagaactgtaccaggatttagacggcctggctaactctgggaactcaagcaagtcatttaatctctcttgatttgataagcaaaataagagttttgatttcatgaattcattcattcattcacaaaacaaagatgtgccatagattcagcaaggcactggaaaattggagagccacgcactaacctctgagggcagcatacctggaatccctagagtccctgccagtccaggatactataagtgggtgaatagagatatcattccttggaattttccacacaaaaaagaacaatgactgctgatattctctgctatggctaaggctgctggtactccttgataccctgtaatttgctgtcttttccagcaagttgaccattgattagctctggccagtggattgtaagtagaagtcatatatatcaattctggcccacagtagttatgtatcaagagttccattttttgccctcttttctattccatgtgcaggctggatgatgccaaggtgacatacaaatttgtattcacattgtgaggacaaatatggcagaggcactagctgcaagtgcctgatgtctgggttatttaaaagagagcagcctgactgatagacaagatataacacaataacttctattgtgttaagccatagagatttgaaggcctgcttgttgttgcagcataacctagcctagtgtgcttaactcaaacaactatatattattataaacctcactcaatgacatctaaaattaagagcaatgtattttttgatgctttttatggcaattcagaatctagtatcttattcactgggcatcataaattaaaattagtatttagattctgatattttctatagggcatattgccagttttaatgaaatacttaactcccctgagcatactgtcagaaatgctccaaaaattctttaatgtgccgtgtgaaagtctcaatggtctcttactaatcaacattataatggaaaatacacatactagttaataattaaatatgtcaaaccataaagtatatgaagatattttcattttgtattacactttgcacagaaaatttcacagtgttctcattttttactgctgttaggaggtatctgtgatttccatttcttctttcaccctttcttttcaggtatccagggagggccatatgttgaaccaatgtgataccccctgaagcaggctttcctcattagtatgctacgtcttgcagcattctatgtactatctatcgaaattccactatgttggcacaggtctgaccaacttgcaagtaggcacaatgccaaacatgcagatggcaggaggggaaagagccaaaaaaacacgtgagtcaactgtgggtactgatggcaaaattcccagaaatgcaggtccaaacacttgtccatcctaagcttatagtacatacttacagagacacagatttgtcaacaataatctagcactgagttagatcaattatttaaaatattttaaatctacttttggctactgtgggtaacaacaaggcaatgattcaacaaaggttggtgtttagtctttcgtctttacccagatgacttctcaatagacaatcaggcggcatatttaaacaattatttctacctatattagttatgaataaaggagaaacgtgcatcttgtctttatttatataaactatataattaaaacacaagaaaaatattaagacactatacactgagactaaatactgttagcacagtagggctcaaattgtggctctattaaatattcttccttgacctcttctgcctgcttgatcaaaaaaatttattgtgttttataaactagtaaacttcattatcaggactggatctgtgaacgcataaaatgaatagtacctgatttgaagatctttaaaaggctcattcatttaaataacccattttctgctgttttggcagtttgcctgaaatgtctcaaattattgccacttaggttaagctattgtatctcctgaaggtgttgattttagaaggaaaacattttattgagaaaagaataaaattaggttttgaatatataggtaggatgaagtttaatcattgcagtaaatgctccttagcaactactgtaaaaggctcccagaatctctacaccttacttttgagctttaataaggacaattcctattaaatcagttttagggagagcatctgttagataagttgatactgaacttctagaggtaaggttgaaaatactttgaaaattaatttgtggtatagatgacctatttaatatgtttctcaatgagtcatataatttagtcatgtctcttgaccccagatctagtgtttttgttactatactatcattctgacgttttacagaattgaattggttcatttatataagcattttcagtttaaggtatatgtaggaacatcacattcattcttcaagtgagtattttatgaacaatgtcatataaatttagaattttaatctagcatgaagaaaacaatttgccctttcaaaagtgagtctttacatcctgccacatttccagaaattacttaaattccagcatttagtacacatgacatttggtctctcttttgattggacaccatactgccatttatgttttgattcctggtcaatttatgtctattgcctacaggtatagcttgtataccaaacactgaaggcatataggaatacctcagagatattgagggttcagttctagaacaccacaataaagctaatactgtgggaaagagagtttctggggtgccagttgagttggtctcccctgtgtgagacacccatggggagccatgggtggcctctgaagagaaaagtctccctattgccttcatgtctttatgcccggagagaataaccactcagcggcatgccacaggttgctcagggagataacactcccttgaagcagtggagtataatcaaacatcttggctcctcctgaaacccactcccacccatttcagtcctgataagttaaagatcttaagtagtttagacacatgcctttgctcaaggaaattcacagaaaccgccactgctatacatcttattgaatgactcacgagttctccttcacatattaatccttttcctcatcggttcctccccctctcatctgccctaagaacaaagggcttataaaccaataaatcgggcagagcccgagagctctgggccgtgagcaagcctccgacgctctggtcccctggacccgccttttaaaagcttattctgtctctttctaactcctttgtctccgccagactcggggtacctgctgggtggtgtggggctggtttccccaacaaatccagtaggaaagtgagtcacacaaaattttctatttcccactgcaaataaaagttataatcacttggccaggcatggtggctcgcctataatccccgcacattgggaggccgaggcgggctggtcatgaggtcaggagatggagaccatcctggctgacacggtgaaaccccgtctctactaaaaaatagaaaaaattagcccggcgtggcggcgggcgcctgtagtcccagctactcgggaggctgaggcggggatcttgtctcaatgctgaggctgttgaccaatcagggtggtggttgctgaaggctggggtggctgtggcaatttcttaaagtaagacaacaatcaagtttgccacatccattgccacctcctttcaaaaatgatttctctgcagcatttgatgctgtgtgatagcattttatccacaggagatctttcaaaactggggtcagtcttcttaaatcttgctgctgctttaccaactaagttttcgtaatagtctacatcctttgttggcatttcaacaatgttcacagtatctttactaggagtgcattccatcccaagaaaccactttttttggctcatccataagaaccaactccccattcattcattttttcatgacattgcagttattcagtcacatcttcaggctccatttcttattcttgctatttctaccacgtatgcagttacttcctccactgaagtcttgagcccctcagagtcatacatgagggttggcatcaacttcttacaaactcctgttactgtcagtattttgacctcctcccaagaatcataaatgtccttaatagcatctagaatggcaaatcctttccagaaaggtgtacttttcccaggtccatttgatgaatcactatctatgacagctatagccttacaaaatgtatttcttaaataataagatgtgaaagtaaaattactccttgatccatggcttgcagaatgaatgttgtgttagcaggcataaaaacattaatctccttgtatacctccatcagagctcttgggtaactaggtacattgcaaatgaatcataatattttgaaaggaatcttattttctgagcagtaggtctcaacagtaggatgaaaatattcagtaaacaatgctgtaaacaaacgtgcttctattctggctttgttattccatttatattgcacagttagagtagattttgagatgattattaagggtcctaggatcttcagaatggtcaatgagcactggcttcatcttaaagtcaccaactgcattagctcctaacaaaagtcagccagtcctttgaagctttgaagccatgtactggcctcttttctctagccatgaaagtcctagatagcatcttcttcagtaaaagtctgttttgtctacattgaaaatctgttgcttagtgtacaccttcatcaatttagctaaatcgccaaatcttctggataacttgctgcagcttctctgtcagcacttgcttgctgtgtcaccttgtactttaaagctctggagatggcttctttccttaaaactcaagaaccaacctatgctagcttccaacttttcttctgcagcttcctcacctctcttagccttcatagaactgaagagagttagggtcttgctctgaattaggatttgacttaaggaaatgtagctagtttgatcttctgtccagaccactaaaacttgctccatatcagtaataaggctgtttcactttcacttcatagttcatgggagtaacccttttaattcctttcaagaacatttccttttcattcacaacttgaataactgtttggctcaagcggcttagctttcagtatctcttggctttcaaaatgccttcctcactcagcttaatcatttttagcttttgatagaaagtgacagatatgcaactcttcctttcacttgaatacttagaggccacggtagggttattaatagcctaatttcaatattgtgtctcagggaacagggaggcccgagaagaaggcgaaacagaggaatggctgcagcttctccatcagcagtcagcgaagaagtcagaatgcagaattgatgaggttcactctcttttatgggtgcatttgtggtattcccaaacaatgacaacagtaacatcaaagattacttatcacaaatcaccaaagcagatataataatgaaaatatttgaaatattgcaagaattaccaaaaagtgacagaaacataaagtgatcacatgcatttaaaaaaatggtgctgatagatttgctcaaaatagggttgccatagaccttcaatttataaaaagcacagtgtctgtaaagtgcaataaagcagagcacaataaaatgaggtatgcttgtacttcagaacaacaccagcatacttatgtttgcaaaacatgaaacacaatcatagaagctgatgtttgagaaatccacgttatttttaccttctttacaagatggaattattgggtttcatttgattaccaagaaggattttaataagttatacataatcaatgactatccaaagagtagaattttctctatcagaactatgtttttcttgtagtatattaacatgttaagagatagccttactcttaaagttcaacttgtacatcagatagattaaaatgtcattagcttgctggaatgctctttctataatctcttcctgacaactcagtcttttattttcttttttaatttttcttaaatcattcctatagacgtctcaggttttagaatctgacttccagccattgagaaaacaaagaaactagtatggtagtgtatggttttctcaaattataattaaggtgtacatataaaaattttaacacctttttttctctactaaatgtgattagaaggctccctgtcccttatatattatagaactcaattataacacagcttattattatacaggttttgaaacaccagaaattataaaatctccctcagacaaagtttacacaccaaaacctgaaagagcttatttgaactaaacgaggaggttttgctttatgatcattcattttactctcttctatattccttccttccttcaatcatgtggtcatttattcattcaccaagtaattgttgaaaatttactacatgtcaagaactggggcagatacaaagaagatatggcatgtagccaaaagaaaattcctccttggtacaaggttcagaattgaaaagattatataatttctgtaatgaatacgtgaaaggagatgaggttttcattcaaggtagaaaatgacatccattataaaagtgctattaataacagccttttaatatttaaaagagaagagtgattaagacagaacccatactttattattctatcttctacatgtattaagtaggtttgaccatattcaggtgtattacatataattaagaataaagctaaaagttctctttttttaatccatatgggacacagtagatggctgtgcctattttaagctatcatatttatgtaaacagcttaacttgccttttctgagtgtaaatttgttgtgtattttgcactttctcatcaaattaaaatgacttagttatgtgagctcaatcacataatacctttgagagtttattcattcaactttaagacagtcaaacagtctcattctgggagcaattagcactcagataattattacctatattttcatactatgtcaacagaatgattttattaaaacaaaattttttaatacatctattgcattttgggcactatagttgaaggtcatttttaaacaagagcagtgtcaaattttacactaaaatataaataaaacaatattttattactagattgtgaatgtctttatatgtaggaactatatgttgttcatctttgtatactccctaggatgtagaataatgtttagttaaagcagaaagttaaaaagtgtagaattaaattaaaataatgagcatatggattgttttctaaatataaaaatgttttatctagttgtaatgttctactagttactaactagttaaaatgttctaccttttattttataccaaaatttgctggtattgcttttggtctactgacatttctagcatttaattaccacaaaagcaatctgattcttttttaacatgttactttttttatcaatgtaaattaaaatcttaaaatccataagataaatgataaatgttaaacatctataaaatgccaatggaaaccctactaattaacttgagaactgatttgattttgggtaccacttaaatcacaaggcttttatagttctatccaatgaaattatttttataatctctttctaaattgtgatatacatttttaaaaatatttgattttcttgttgaaccatgatgatacatttccccccaaaatacataaaaagttgaatagactgctgtcttcaaaattaaacatttagttcagaattgacaatgaaagcatatatatgaggatcatttttccaccttgaaataatcttttgaaaaataggatattaacttgactttcctcaaagctacttacaagtagaactctagaataatcagttgcattatttggacaatatgtagatattttcagcttttacttttacttgcacccaatagaattttattgtaactgcaaataattgtttattgacagatttgaatatataatttaatatggatgggtaacttaattataaaaccagcatggaattaaatatttctgttattaagacagatgctcatcagaatcacatatattgagatcttatttgtatcaaatacagatatttttatttttatcttgtatcaaatatagtaataaaatgaatgttctcaattaattgtttcaacaaccttatgagaaagatgccattagtgtcccattttaaaaaaaggaggccaggtacagtggctcacacctgtaatctcaacacattgggaggctgagacaggaggactgcttgagcccaggagtttaagatcagcctgagcaacatagggagaccacaactctagggaaaaaaagaaattggccagtggtagtccgcagtcctagttactcaggagcctgaggtgggaggatcacttgaacccaggaggtcaaggctatagtgagcctgcatgacagagtgagaacctgtctcaaaacaaaaacaaaaacaaataacaaataaaagaaaaggaaactaagggttagtggcctcaagatctccaactcagagctgagacgttctctgaataatgcatatttcttaactaacaattgttaggtttagagggttagaaagagttgattaacaaatatcaaaatcaaataaaaataaaaagtagaaacacattatgacatcaatatattatttcattatttttcctaaattagcaattgtagaaaaattacacaatatctctgaggaaatggattatggcagattctgtgattatttgccaggaaaacatgaaatcagtgataactgtatttgagatctcataataaggaaaaaagttgtttgcattgagatggattgtatctctgatgtccttgactggcagaccaaacactttttccctgctgttacaaataagtcagaaactgaatcaaacaatctaacatgtttaataattaaaatatattaaactacgttttcatttgcctactaaagttggatatcaacagatttcaaaaagagatttaggcacctcatccaaaaatgtataaatcaaggaaaagaaaaaatcaataaatttcacattttaagtgttcaataccaaagtatttattcagcactgttgtaatctgacaaactcaaccttctgtctttgtcatctagaaatagaaccttcatcactaaattatttgaataatcaccttgactatttttcttaaaactacttggattatacgtaaataatgtagttattacagaactataagaggacttctcattccaaattgctactttagaagagttagattttatttattttttgagagaaaggtcttgctctgttgcctaggctggagtgcagtggcaagctcatgactctctgcagccttgacctcctaagctcaagcgatcctcctgcctcagcctcttcagtagctggaactacaggtatgtaccaccaccaccacctggctaatttgtttatttttggggggatggggttttgccatgttgcccaggctggtctcatactcctgagctcaagcaatctgcccaccttggcctcccaaagtgctaggattacaggcatgagccactgtgctcagccatatttttaaagaaaaacaatttttcatatctcaagtaaactaaacaatgtattactctagttatgagtaatatgttgttggaattctcagcaaatgaaacaaaaaagtaaactttaaagaagtacatatttaaacaaagtcattgaacaaagacaaaaaatatgtctataaaaatcaaatatccactctctcccagtgccatttgtaacaatactgttaatactttcttgcctagttgaagggttcaatgtactttccaaaatctgtaatttgcattcataatttggaattaagttgaagatctgatctggaataagccattcacatagtaaagatgagtgaagaaagctgtgtggttcagaggcacactgaagaagagcccatcctctctcaagggaaatctggtgccctgcttcagttcaacactgccatgcaagaaagatgtgagggaagttatatttctaggcattttattctttttgtggccattatgaatgggattgcattcttgatttggcttcagcttgaacgttgttggtgtatgggaatgctactaatttttatacattgattttgtatcctgaaacttagccgaagtagtatatcagatcaaggagcttttaggcagagactatgcaatggaaatcacacaatactgctcaaagaaatcagagataacacatccatgctcatggacaggaagagacaatattgttcagatggccatactgcccaaagcaacttacagattcaatactattcctatcaaactaactatgaattcttcatggaattagaaaaaaaaaattttaaattcatacagaaccaaaaaagaaccttaatagtcaagttgatcctaagcaaaaggaacaaagctggaggtgtcacattacccaactttaaactattctacaaagccacagtaacccaatccgcatggtactgctacaaaaacgaacacatatagaaatggaatgaaaatagagatctcagaaataaggccatgcacctacaaccgtctgatcttcaacaaagctgacaaaaacaagcgatagggaaagaattccccattcaataaatggtgctggaataactgactagccatatgcagaagatcgaaactggaccctttccttataccacatacaaaaatcaactcaagatagattaaagacttaaatgcaaaacctaaaactataaaaaccatggaagacagcctagggaataccattctggacataagatttggcaaagatttcacaacgaagacaccacaagcaattgcaaaaagaaaaaaaaaacccaaaaattaacaaatgggacctaatcaaactaaagagcttctgcacagcaaaagaaactatcaatagagtaacaacctacagattggaaaaagcttttgtaaactatgcatctgaaaaaagtctaatttccagaatctaccagaaatttaaacaaatttacaaggaaaaaacaaaacacctcattaaaaagtgggcaaaaaacatgaatggacactgcaaaagaagacatacacacagccaacaagcatataaaaaaggcccaaaatcaataatcattaaagaaatgaaaatcaaaatcacaatgagataccatcccataccagtcagaatggctatcattaaaaagtaaaaaaaagtaacagatgctggcgaggttgtggagaaaagggaacacttatacactgcaggtgggaatgtaaatgagttcagccattgtggaaagcagtttggcaatttctaaaagaacttaaagcagaattatcacttgacccagcaatcccattctggggtatacgcccaaagggatattaataattctgccataaagacacatgcacgcatatgttcattacagcactattcacaatagcaaagacatggaatcaacctaaatgcctatcagtggtagtctgggtaaacaaaatgtggtacatatacactatggaatactatgcagccataaaaaagaatgggattatgtcctttgcagcagcatggatggaactagaggccattatcctcagcaaactaacacatgaccagaaaacaaaataatgcttgttttcacttataagtgggactaaacatcaagtacgtatgaacacagagaaaagaataacagacactgggaactctttgagggtgaagattaagaggagggtaaggatcgcaaaactacctattgggtactgtgcttattacctgggtagcaaaataatctgtatatcaaacccccatgacacacaacacataatttacctatatagcaaacctgcccatgtacccctgaacctaaaagttaaaaaaaaaagatgagaggagtactgccacatcttgtgattctttaagagatacgtgaactttaaaactttgtgtgtaatatataatacttctatttaaaaatatttgccaatctcacattaaaaaataagtttttggcttctgaggactcaggagataagagttgttccccagaaaagagagaattctactactataggaatttataggaatgtggctcttaaattttagcatatacctccatcacccagggcatttggctcctggggactcaggagataagaattgttcccaagaacagagagaattctattactataggaatttataggaatgtggctcttcaattttagcacataccacaatcacccagagcttgttaaaatacagattctttgggtcctttccttgacatttggattcagtaggtatgggatagggtcagagaatttgcatttccaagttcccaggtgattgtgatgctgctgttccaggggccatactttgagaatcactgacccactttggtcataatttgaaaaaccctacacacggagttttttcatttaaataaaaggaataaattatgagccactattaactttttaaacaattttattgatgttaatgtatgtatcataaaattcactcattgaaaatacacaattcaatattttttggtaaatattttatagagttgtgtaactataccaaaattccattttagagctaaaattcagagctacaattttttttccaaatctgtttgcaatcaatctctcctctgaccaccagcctcaggcaacctctgatataaatttttttctgtataaatgggtttgttctgctttgttttacataaatggaacatacatgcaatctttccatccagcttccttcacttactatgatgcttgtgaggttctaccatgttatagcacatagcaatattttgtttcttttaactgcaaactaaattttacaggtaaactgcattttgtttgtccattcaccagtttatgggcttatgaattttcccagtttttggctataaagaataatgtcgatatgaatattacatacaactatttcaatgagcataaattttcatttttgggaggtatatttctaggtgtagaattaacttcttaagaaacttccaaactgctaaagtagttgtttcattttatctactggaaactagtggaggttccaggtattggacatactcaccaacactgggtactgtatggttttttgattacagccttctcagtgggcatgtagtgatatatctttgtaattttaatttgcatttctttaattattaataatgttgatcacatcttcattttcttattagcatttataaaaaatcttttgtgaaatgtctgtttaagtaattagtctactttttaaattggattgtttctcattattattattggagagagatatttatataatctgggttcaagtcctttatcagatatatgatttacaaatacttttccactctggcttatctttccattttcttaatggtatcttttaaagaacaaatagttttaattttatcagattccaatttatcttattttttatttatgggtctttcaatataatgtctaaagacaccccgcctaacccaaagacacaaaagatttcctcatattttttccagaagtgttatagttttagaacttattagtattattgacttttatcttttttcctattttttttttttttttgcaggaggcagcctaactggattttgtcggttttcttatcttataaaaaaactagtctttggtttcattcattttctctactatttttcaactttatatttcattgatttgtgttctaatgtttattattttcttccttctgctttagatttagtttgcttttctttttatgatttttaaggtataaacttaggttactaaggcctttttttctcttctactacaggcatttacatctataaatgttcctctaaaccctgctttagctaccttgcataaagttttgtatgttagagttaaattttcattcaggtaaaaatatgttttattcttctttgtggttttttttgatccatgagagattcaaagtatatttatttaatttttactctttgttgttttcccagatttttttctgttgtgaatttttaataaaattttgtcatggtcagagcaacacctagtatgatgtcagtctttttatattcattgagacttgttttgtgaaacagtaaatggtttctaatagaaaatgttccacaagtgcttgaacagaatgtgcgttctgcattcatttggtagggtgtttaatagaagtcgataaatgccagcaatggaatatttgtcattttttaatctgggaaggtctgtcctcagagatcttcattattaaatgattctattgatgaccacactattatgttcatccaatttcatcatcattagaccataatattgctgaacatactattcctatatgagaggggttttttctttcagccctttgaatatgttattccactatcttttggcctttgttgtttctgattagatgtcaggaatttttttgtattgtcctttacctgtatgtaaagagttatttttatgttgctgccttcaaactctgtgtgttgtatgtaatattttcgtttaacaacatttgccaaatgcacattaaaacaatgtactggtacaaaaatagaagcatagaccaatggaacagaatagagagcccagaagtaaggctgcacacctacaaccatttgacctttacaaaaattgacaaaaacaagcaatagagaaacaactcactattcaaaaaatggtgctggaataactggctagccattttcactttctctttgtctttccacagtttgactcagcgtatcctggtgcagatcacttgatatttatcttatttgtggttggttgattttagagtgctgtagattaatgtattacatcaagtttgagaaactttcaaacattatattctttttttctgacaccgcagacctgctgttgagccactctagtgaatttttatatttttccgttattgtactttttcatttccataattcccagttgtttaatttaaagtaattgttatatcttttttgaaattatctcttcagtgagttattttcatggatccctttaattctttgaacaatttttatttttaaaacacatttataatgactgttttgataacaacatctatgttttaacatctgggaaaattcagaaactatttatactgactgcttttgttcctcagtatgagtcacacgttcttatttctttgcatatctcataattttctgttgaatattgaactttttatgcaacataacaactcttgatttttactttctcttcttaagatgtatattttttttggcttgttatttattttgtaattttgcctggactaaatctgtgaagtctgccttttcactgtgtatgacctgcaatgcagacctcttctacttttgctttttcttattctttatttttaagctttgcgtcctaagggtgtggtagtgtgttgctgttacacatagcttagcgttcacccaaagattggtcagagttgtgcttaccaccttggttattaagtgtttcattttttgctgatagatatatatgtggcctaaacagaacatttacattttagattacatttgaagtttttccaggcttttactttacataaggctttctgacatctttgtcgcacatgcatagataggctttaaaggcccaggaggtgtgggtagcttgggcctgttgtgttctctgttgttcatgcacataaactccagtcaacctgagatatatgcggcgtttatcaagccatctttgactgtccaacctcccaaaaatgtctgtcaaatccttggctagtccactgatgcactgaatgcaccatataaatgtgcacactcatactaacgaaattgccacccttcctgttctcttgcaactgagatggccacttaaactggtgatactccaaatcaaacgagccctttcggcagtggcagcaagccctgccctgtcctggttgaactaccatattgacacaactggaaagggggtggatgggagcatgcccaggaaaaaatgccatggtcttacaactgaagttcatgcattttattcataaacacttagttggttttatgcctttggttgaattctggagcaaagaattacttgtttttgacaagtttgtccagctttacagttttttggggaaagaatttgtcagcttctcactttgtcatgccttccattgactttcgactgcttgatttatacaaaattatttaaaaataacaaaagtttagatagagaaatatatggtattcttatacagataaaagaactgagacaagaaagcatacggaattggcctagtttttcactaaaagttaatgaccaagttgaatgtaaacccaactttttgattaacagtcccatattatctatggcctgatattttctgaggccagaggattcaaaagtatacttcacagttcatagctgttggttataaaataaaaggtaaatattaataacaggaagctgtgaaccaagattaaatggatgttagatatatttttaaactatggttttaagtagatttccttcctaaataataacttctctttgaaagcatatttaaaagtgaaaacttttctcggcagtcataatttatctaaaaaccactttattttgacaccatctcctttgaagaaggcatcatggagaccacctatgaaaagagactaccttttccttgttcatgaaagctgtttcaaaatgaaatgactacattatttccaatagctggtatgagccatagccatgcatgctccctcaggtgcagccttcttaactggctgaaaaataggtcagtgctctacattgaagaactgtttccttcttatagttcagtcaacagcctacagtatagtcttccatacagtaagctcaggatctcaggatatttgtgctaaaattatactccaatcaaggccacacataaaacataaatgcttttatattgtaacataatctgaataatatcaataaaatagtcatatattatcttgtttggaaattgttatataatacaaacgtatataatacaatgtattctattataaatataatattatctgtaaacaataatgaggtatatggaatcaaattgctgctgaatatgtttcatggggaacattgtgtgttgtagtagaaagagcttaagttttagagtcagacatatcagtgtttgaatcctaactctattacttaatagctatgtgatttaatgttatttactctctctttgctaaaccctagtcatcttattgaggggttacagtgttatgtttctgcaatgactaaatggttatactatatagagaacaccaatctgacctatagaccagtgctaatactgctcattgctgtgcatttcccagctctggatcgagacacacgggcatatcaaatcagctgataattttggatcttctccaactgatgttttagaaatgtttgtttaacatatatttaacgaatactgagaaactcattgtctaatgtttgtattttatatttattgtgttatattcagaatataagacatatttcatattctaaaaatttcttagatgatacaccaagagtttaaatttgaaaaaaaaatctactgctcctggaaaagagtattcataaggaattggtttcagcttctttctctctccgggattaggtaactgctaccattccttgcttcagatcaatagagtggtagaagaataccttttcctagatacttgccaggctactgaactatcccccgtctcttgggctatcttcaaaccctgcttacaccttgagacatagtctgttcattaaactattctttaaataatcctaattcaggccaggcgcagtggctcatgcctgtaatcccaggactttgggaggccaaggcgggtggagcacctgaggtcaggagtttgagaccagcctgaacaatatgacaaaaccctgtccctactaaaaatagaaaagtcagctgggcatggtggtatgtgcctgtagtcccagccattcgggaggctgaggtggtagaatctcttgagcctgggaggcagaagttgcagtgagtggagatcgcaccactgcactccagcatggatgacagagtgaagactctgtctcaaaaaaaaaaaaaaaaagattctaatttaaatgtgccatctctttcctgataagaccacgaaaatactaaaaaattactgttaattttgtgagatatgatgaaagatggtcatatatcatgtataatgaataaaaagccccatcactgaaatacatacacactaaaatatttgtaggaaaaatggcctaatttctgcaatatatataaaaacttggggtgggaagaataaaattgacacactgttgatcatgattgaagctgtgtgatgagtacatgtagtcatcctagatttctctccatcttgtggcatcattgaaggcttccataataaaaagtttgggatttttttttgaactattggtactttgaacccctttgataaattatttttaattatgatctctggtttggtaaccctgtcatgaacccaaatggaacaaccatttctacgataagtaagtcactgttttctcttttatccattctgtagccctgatctgaacaatgctctccctattccagttgaaaacttctttgtgcatgatcccaaacttcatcttcatttgtcccagggaagctgaaagatgcatatgtgaccttagttgcagattaaaaatgaaatattcttagtttgagttagacttttctggaaacaagaatgactgttctggaaattatactcttttgtcatatttataccatcttgaaaagagtgttatcaagttgtccccactaagcagcaaggaaagaatcattctgcccaacaagggattctctcttgttagactaatgattgggtacatgtccttagcaggtcacttaagtaacttgctctaatgacctttaaattagagacataacactgttgacagtagtcaagatatgatgatccagttactgacaattaaatacttgacaagtagtcaagatatgatgccagttacattgacaataaaaaaaaagtagaaaaagtaaaagttttatttgtgtaatagaaaaattttgttttggtcttttttattatttgttcgggtaactagaaattcaaaatattttccagtacttattaatgcgttgtcatcattacattggacccacaaagttaaattgtgaagtaaaggaacaatatttgaagaaatatagcattggaaatggaaggcttaaaatttttaagtcagtaatgatttagtatgacattttacatatgctgaaaaatatgtgcacattctcaaaaagctaaacaaactaatttctatattatattttatgtaacattagtttttcaaattcaatcacatgtaaatattttcccaaaagagtattttcttcacttgtctgtggtttaaataatttcaaggaaaaaaatgaacattctactggaattccatgtgattaattatatactatcaaggtcaattcagtgtgcactcattcatttaaatcaggttttttaaaacctcactgcaatggacagtctgagccggattcttcgttgttgtggggggctatacagtattgcacattacaagatgtttggcaatatccctggtctgtactcataagataccagtagcactcccaccctcaagttgtgacaataaaaaatgtctctgaacattgccagagatctccctgggggcgaaatcaactccactgagaacctgtgtttcaaagcaatgagttctgtattacatctgcctaaattttaattactttccaaaagattacagctcaaacaatgggaagagtcaacaaataaaaagaaataaaagattttgagaaaggcattgtgataagagatagcttttccaaataaaaacacctttaagagtaaatattttaaaaaataatatgtggttaatgtaaagatatgtaagagagtgccatagtgaactgatatttaaaaactcaagttgcttacaaaatcgtggacatgataggatatcaaacaatgcattttcatcagactgattttgatctgtgcatctaatgcagttcgtaatagagaaagaatgaattctaaacctccatacatacaaaccaaaattacacacacgccacacacagacacacacacattgatgtgagtgtgtgaacttagcagttcacctatttcggccaccattttccatcaaatcttcatgttaaatctggttgtgtgaagatctaattgggtttacacctatatgcttacaaatcctactagtaatatgtttaattcatttatttagctttcaggaacctctattttatgctaaatatcctcagcatttatattcaatggtggtgtaacactactttgaatttactgtcatatttcagcatcgatttctggttgctttctttcatctctgcaactgcatagttagtccagttgggtcaccaggtcttgcctactattaagtgttatgcctataattgaaaagtcattaaagcaagttacttaaatgatttgccaaggatatgtatccaatcattagtccaatgacagataatcttttattggaaacagttcatgggttggcattatccactgtatacagaacagaattgggaatttatttagtaatttgtttagtaaacctagataaatatttgaaaacttatattgagctttcctctgttttgtggtcattttggtagctctatcaaaagctgtgggtattatttttctcattcactggtgaaaaaaggagaaaaatagaataaacatccaaatttctggcataatagcaattctgcaattattatactgaagaacacaccaagaacattagagttagaatggatttcaactgaaaatattctccagatccttatgcatacttgactctatataaatcatttttggaaggttcaaaagaagtgtaggataagattatcctgaagagctataatttttgtcgggtttaagatctatttttccctgttaacatgaatacttccaattttttaatgaaatagaattataatgtttataaaatacaacattgtagaatgaaattacatattttagtaggaaaatagaatcacagaaaaatgatttctaaagcagcaacttttatttaactcccagagtaaaaaactatcaattcttgccatgcaacaactcaataaaaagaaaacgcgctaactatgatcttttgtggaggtgccgagtactggcactaaaaacttctgctatatggaagtaagatggaaatttttagtgtgtgaaccctataccatgtaattttaaatggtttgttagtacccaaaaaagcatctttgggtaaagtgaaataaataccttagagaaaaataacttgctgaaaagtacaagttgatgaatttcataaaatttcaacagtcaatgtaagctctggatcttctgtttttatacatattttgtattcatttgccaagtcaaaaatcttaaaagccagtcaccacaacctccatctaacaggtctttccactgcactgacagctgctctcacctttataaaatagcccattctctcatggagtttttgccctgatgcagactgcagtgacctttctataactgagtcatgaatccctaaacacagagacgaaatcacccacgatgccttacatatggtggtgtgaatgtctacaataattgctctgtaattacatggtaattattgaccatttaagtacatttaagaacagggtgactatgtaatcaaagactaattatctgattatttctgtcttttaaactgtgggcttataagatataaaaattgcaagtaacatggtgattagtcattgaactacatagtaacttgcagcagaattatgaagtaatctgtagaaaatgtatttgtattgtcgtactcctggacagtaattgaagagtagttatatggtaatacacattctatggagtgaaaacagaaaaaaaactatcaagacattatgctaatagagcataaatatgttaaccaaaatattacatgattcattagagcaatatatgaatgggatatatctttcgcaagacaggtaattggtaccttaaattagaatttctatggtttctctataaaatacagaagtgccactgtgccttttaatagttcttataaaattccgttgcatatttctttaaaaaattgctgtgatatgacaaataacttgggcacggacagataaaaggaaggtcaaaaaagatggagttcagaatttggtctactgcactgggattcagtggctaaacccaatcaagggggtagtttaacttcattagcaattactgggacccaagttggagtcgtttacaaaccctcaacattttcttcctaaaataatgaagtaacatgagaagtatatgggtaagtatttacaatgattctgaaacacactaaaaatatttacctaaaatattttaaaagcttctactttaaattagaaaaggagataataaagaagtttcccctaagaattcatttgatgtaggctgaatgtagaaatttcctgaagaaatacagaaatggtggagttttgaagatgggcaagaagagaagggtttggagaaactatggcttaacatgtgtttgttataaaagttgaaaatcaactattttgttgagcagtgatgctaaaaatgagtaacctttaatctttaaagtctatttaaataaataactacttttttcttggtaatatgattaaaaacattaatatgagccctgaaataaagatcatgttgattccatcatgaagtaattataataatattttgtacataataaaggtatggaactctaaaatgaaaaatggattctacatgaaaaatatatcactctacatgaaaaatgtattggagcaatagttataaatcccttacctaaggaatatgaataatttgaccacatctaaagaaatgataatgctctcaaaactaaacttgattactttcaaattctgattatttgacatagtgttaatatcataattttttagtgattttctactttctccaacaggtccatgaaacaaaatacacttttgagtattgttgcatggcttattttggattgtcaatttacattgtttgcctggtatgttccttctctttggaattctacactataataaagtatgaaatcttctcaaatattctcttgtccaattagttagatacaaatacttagtcaagtgaaatgctataagtagtaacttataaagttgttactcttttgacctgagcagctactcataaagtgaaatcaaaatggactggagtagatttatttgatcaggatcgattaattcatgtatcattactgaagtatttcctttgattgagagctcattaaaggtgtctgctttacatcaaaatgtcaataatgcttctaaaatggaaatgccattttattaaggctgtgttttttaaagtaataacttaaaattatttacaattgcttttcaaaaaataaaatttacagtcctaatttttttaaaaaaattatatacactgttttacgaagcatacaaaaagagaaaataatgaaaaactatcatgttctgagttatgcctttggtcatcctgagaaaaggagttaataagtaattaacaaggcttgtcattctgtatatacaataactcatctcaaattgccttctcccttgatcccttttcagaaaaaaaccctgtatggaagtatgattgacctataaatagttttacatgcctcccttgatttcttcttaacttatataaccttcaatttaaaatttatacctcctttataaagaggtgaggcttgaaaattggatcacatatattaaacatgaaacaatgttttaattgagtttaccatacgatattgggatttccatgaaaatacagatgagataaagctacccattatatcgaattcctgaggagatatgtgccatatacaagatatagcaaggtagttcaaactgacttcttgccaatctcacaaagaataattcatgtaacttacaattagactaaatctttcctttgtctctcatttctcccactaattcgttgttcttgtatagaatgtcattttctataagacaaagatgctagcagaaaatgtcatgaatgaatacaaactttatttcccggttcattttatctaggctattttctttacaaaataacttcagaatatatacaatgtaatcaaataacttaaatttaaaccaaaaaaatctataaaatatgaaataccatgataactttagaccatttaatatcatctccaaatattgtcacagacatgttataattacttctacatttctatattagaaaatacacataaagtgcagcttgtttctccaaatacacttatctattccttaaaaatctggtacaccaaagggaatgctgacttttaccacatataatcagtctttcagtagaggctatttcattggacgctataactaaagcaataaagaaaaagagaaataaactgaaagtatctaaattgaaagagaagaaaaaaaacaatgttttctttgaagacaaaaatgatcttgtgtgtagaatattccaattttagagcccaacaaaaacatcactggaatttataaataagtttggcaagggcacaagattcaaaatcaatacagaaaaattaactatttctatatactagcaagtaataatcatacagtaaagtcaaaaaattattccacgtatggtagtttctaagactaaaatatttagaaatgcatttaaccaaagaatggaaacttgcattataagaactaagaaacgttgctgcgagtattgaagaaggactaaatgaagtaagagacagtttatgttcatagattggaaaataaaaatgccaagatagtaattgtgaaaaataaatgtaataaaatccttatcaaaatgacagcagattttttttttgagaaatcaacaagatgattctatgtggagagaaagaacccagaaaagccaaaagattttgaaaaggaagaagaaaattggaaaagttacactatctgatttagaaactttctacagaagctatagaaatcaggattgtggtattggtataagaataggcatataaataaatgaaaaattaaagaaaaaatactcaatatttatggtcaatagatttttgagaagggcatcaaacaattcaatagagaaaataatagaacttttatcatgctagtgagataattagataccaatatgcaaaaaaaaaatgaagttaggccttccctttaaaccatatacaaaaattgcaatgaatcctacatccaaataaatggatcatgttctcagaactatatccatatcgttctcataactcagaacactgtagtacttttagaataaaatataggagaaattcttcacgacctttgggttagggaaaatgttcccagatataacaccaaaagaatagctcagaaaaataaattaaacttcacaaggaacaacaagaaacctaaaatgtcatgagacctacaaaaaaaaaaagacaaaatggtagatggaaaaccaaccatatcaataatttcataaatatgaatggactaacacatgaatcaaatgtcagagattgtcagctaggatacaaaacaagatctaactatacatactgtctacaagaattatgctttagaaccaaatatatatatggattaagtgtgaaagactggaaaacagctattccacataaatagtaaaactaagagagctggagtggatttattaatatatgagaaaataaactttaagtaaaaatagtgttagagatgcacagttatgtttcatattgataaaacagtgaatatataagaaatacataataataataaatgtatatacatatagcaataaatcaccaaaatgcatgaagtgaaaagtgacaaaattgaaatgaaaaatagacaatttaacacatatgcagatgtataaatgccattctcttaatatttgataagaccgttagaaaatcggtaaagacatggagtcctaaacattatcaagcatatacactagaactgacatagaacaccccacctaccaacaggagctacatgctgttttagagtgtccatagaatattaccaaggaaataaaatatattaggcaattaaaattataagtgaaagtctttccttgacaaagtcagtctgtaaactattctgcaaatgggcagacaccattgcaagaataaaaggatcacaaagaataagggttacatgacactactaaaggaaactaataaaattcccataaccaactctaacgaaatgaaagtctacaaagtacctgtcaaagaattcaaactaattatctttaataaactcagtgaactaaaagagaacacagatagacaactaaacaactgactataaacagaaagttcagcaaataaacataaaccataaaatatagaaatcctacagctgaagaagacaataagtcaactaaaactttcaacagacagcctctatagtagactcagtcaatagtagattcaatcagaacaaagaacagtagattcaattaatcaggtgaatgaatgaacttgaaaacaggtcatttgaaattctccgatcataaaagcaaaaagaacaagaataaatagactgaataaagcttacaagacttttgagataccaccgtgtgaaacaatatatgcattatataagtttcaaaatgagaagagataagaaaagggaagaaaacttatttaaaagttattatttttaaaagttattatttaaaaaaataatagctaaaaactttctaattctgggaatggaaatggacatccagattcatgatccacaagtaaccgaaatagttttaaacctaaagaagtctacaatgagaaacattataattaaattgtgaaaaggcaaagacaaagagagaattttgaaagcaataactcatcacagaaaaaaggcaacacctataaactatcagcagatttctcagcagaaatgtttcagtccaggagcgggtggagtgatacattcaaagtactgaaagcaaaaaattgtcaaccaaaagtactcagcaaaactgtccttcaaaaatcaaagatagataatttcccagataaacaataactaagggaaatccttatcactagatatatcctgcaagaagtactaaggaagttcttcaagttcaaatgaatacatgctattcagcaacatgaaagcctatgatagtacaaatctcacttgtaaaggtaaatatgtaggcaaatatacaatgttctaatactgaaatgttatataaatcattttaaatactagtaaaaaattaagagacaaaattattacttataactatcaccacaaattttgtttaataaataaacaatagaaaaataataagtaaactctgataacaataacaaactacacgtggaggagaataaaagtatagagggctcatatacagttaaagaaaagttgttatcagctaaaagtagactgttataattacaagaggttagtccaggcttatggtaactataaaataaacaaaggtagtagatatgcaaaagacaaagaggaaaaaatcaaagcataccactacaataaaattaccaaaccacaaagaaagccaggagaagaggaggggaacaatataactacaaaacagacaaaaaacaatggacaaagtgggaacagtaaaaccttagccaacaatattcactttaaatgtaaatgaattaaacggtttaatcaaaagacatagagtagatgaatggacaaaaacaaagaaccaactagatgctttctcccaaaacaggacccaactagattctctctataagagactcaccttagatttgaagacacacataggctgaaagtgaatcaatagaagaaagataatcttggaaatggaaaccaaaagagttgggatgactatacttagacaaaaatagacaaagtaaaaaaaagaaaaaatacaagagacaaaaagtagaatacattttcttttaaagcacacacagaatattctctgggataaagcacatattagtcacgaaacaaatctgaaaatttaagaagattgattatttcaagtatgtttcctgaccataaaggaacaaatatagaaatcaattgcagaaagaaaactgaacaatcacaaatgcatgtgaataaaataaactctcgaaaagtcactgggtgagaaaagaaatcaaaaaggaaattagagaatatcatgagacaaaaatgaaaacaacatatcaaagcttatgggatacagcaaaagcagtatgaagagggaagtttatggcaataaatatctcttttaaaaagaataaatggcaaggcacagtggctcacacttgtaatcccaaaattttggaaggccaaagtagcaggattgttaagacaaggagttcaagattagccttgtcaacacagtgagaactgtctcaacaaaaaaacaaaataattagccaggcatgatcgtgtgagtctgtagttccagctactcaggaggctgaggcagcaggattgcttgagcctaggagttcaaggcagtagcaagctatgaatgtgccataaaactctggcctgggtgacagagtaaggccctgtctcttaaaaaaagaaaaaaaaaaaaaaaagaaagaaagaaagaaaaattaaaaagaagaagtatctcaaatcaacaacctaactttatacctcaagtaactacaaaaagaacacgctaaagccatagttagcagaagaaagaaaatgctgaagattagaacagaaaaaaatgaaataaagaatagaaaatgatcaacaaaactaagagttgctttttatttattttttaaaattcatttggagacggagtcttgctctgtcacccaggctggcgtgcaatggtgtgatctcagcttactgcaacctccgcctcccatgttcaagcaattctcctgcctcagcctcctgagtaactgggattacaggcacccgccaccacgcccagctgattttaatatttttagtagagacggggtttcaccatgttggcaggatggtctcgaactcttgccctcgtgatccacccccctcagcctcccatcgtactgggattataggcatgagccactgcacctggcctgttttttttaagataaacaaaattgatgaattcttatcgatagacgtactaagaaaaaaagagagaagacccaaataatgaaacaggagtgaatacaaccaacgccacagaaataaaaataacaaaaaggactgttatgaacaattatatgctaacaaattggacaatcaagaaatgaataaatccataggaatatacaagctactaagacagaaagaagaaatagaaacactttaaagatcggtaatgaataaagagttccaattagcaataaaaacctatcaataaagaaaatctcaggaccagatggcttcacaggtgaattttaccaaacatttaaaaaagaattaataccaatccttttaaaagtcttccaaaaatatagaagggataaggaatacttccaaactcatatgaggtcagcatcaccttgataacaaagtaatgacactacaagaaaagaaaatcatatccctgatgaacatgaatgcaatatccctaattaacctggatgcaaaaatcatcaataaaatatttagcaaatcaagttcaacagcatattaaaacaattttgtaccatgaccaagtgatatttatctctgggatgcaaggacaatttaacacatgcaaatcaattaatgggatacatgaccttagcaaacaaaagaaggagaataaccacaaaacaatctcaaaagatgttggaaaagcatttgataaaattcaacactctctcatgctaaaccactcaacaaattagttatatattagatatagaaggaagctgtctcaacacaataatggtcacatatgaatatcctacaactaaaatcatactcaacagagaaatgctgaaagcttttcctctaagatgtgaaagaaggcaaggatgctcattctcaccacttctattcagcatagtcctggaagtgccagcaagagcaattaagaaaggaaaaaaacaacaacaaggcatccaaattagataagaagaaataaaataatatctgtttgctggtggcattatataagaaaactgtaaaaacctcaaaactgagggaattaaaaatcaaaatgaatcaagttacaagataggtagtaaacacagaaaaagcagttgcatttctatccacaaactatgaactatcccaaaatgaaatcagaaataccgtcccatttacaatatcaccaaaaagaaaaatacacccaagaataaatataaccaagaaggtgaaagactagtaagttgaaaaatttaaaaccctcataaaagaaataaaacaagacacaaacaaatggatagtgatccttgagtatggattggaaaatttaatattattaaaatattcattctagctaaaattcatctatatattcagtgcaatccctatcaaaatatcaaagatatttttatacagaaatagaaaaataattctaaaattcatacagaaccacaaaagaccacaaatagccagagcaattttgaacaaagctgaaggaatcacacttcctacagtaatcacgatagtctagtactgacataaagacagatctatagagcaatggaacacaatagagagcccagaagtgaagccacaaatatacagtcaactgatatttgatgaagatgccaagaatacacaacagagtaaagagagtatcttcaatacatggtgtttgtaaaattagatatccccctccaaaagaatgaaatcagacacttatcccatagacaaaaattaactcaaaacggattaaagacttaaatgcacaatttgaaacaacaacaacaaaacaaaactttcagaagaaaacataggtaaaaaccttgttaacattgatcttgacaatgattacttcgatgtggcaccaaaagcacaggcaacaaaaacaaaaataaatacgtgggactgggctgggcgcggtggctcacgcctgtaatcccagcactttgggaggccaaggcgggtggatcacctgaggttggaagtttgagaccaggctgaccaacatggagaaaccccgtctctactaataatacaaaattagccaggcgtggcggcgcatgcctgtaataccagctactcaggaggctgaggcaggagaatcccttgaacctagaaggcggagtttgtggtgagctgagatcatgcgtttgctggaagctccagtctgggcaacaagagcaaatctctgtctcaaaaaaaaaaaaaaaaaaaaaaaaaatgggactacatcaaaccaaaaagcttctgcacaacaaagaaacaagcaacaaaatgaaatggtactctatgcagtgggagaaaacatttgcaaaccatgtatttgaaaagtggttaatttccaaaatatataaggaactcctacacctcaatagcaaaacaaaacaaaataaacaaaaaacaacaaaataacccagttacaaaatggggaaaggacttgaacagacatttttccaaaaaagatacaatgatgctcaacagttgtataaaaagatgctcaatattgctaaccctcaaggaaatgcaaatcaaagccacaatgagatatcgccttattcctgtcaggatggctatcacccaaaaacataagataataactgttggtaaagttatggagaaatcggaatgcttgtatacttttggtaagaatgaaaatgttgcagccactatgataaaatagtatagagattcctcaaaaaaaaaattgaactaccatatgttctagtgatcccacttttgaatatgtatctgaaataatggaaatcagaatgtcaaagacatatcttaacaccatgtttattgcagcattattcacaatagccaagacatgaaaacaacccaaatcttcatcagcagatgaatggataaagaaaatttggcattttatgcattggaaggttattcaccctttaaaaagatggaaatcctagcatttgtgacaacacggatggacctggacattatactaagtgaaataagccagtcacagaaggacaaacactgcatgattcctcttacatgatgcatctgaaacagtctcatgtatagaaatagatagtaaaatggtagttaccaagcaacggtggaggtgggatatggggagctgttgcttagtgagtgtaaagtttgttatacaaaatgagtaaatcattttgtaattggaccaattacaaaattgagcactatggtgctcatagttaataataaattactcacacttaaaaattgatcagagtagatatcctgttaattgttcttactccaaaacaaaaacaaaacaaagggacaccagggaacttttggatgtaatgtatatgtttgttaccttgattatggtgatagtagtgagaatgtatacatatgtctaaactcaccaaatttcattaattatgtgtggtttcatatttttgtataccaattattcctcaaagctggggaaaaataatgaaccaaatcccacactgtcatgttttccttgcactaatacatgaaataagatacatgaagtattgtaaagatgaataaagcttaatcaatatggcaaaaataaaatagcattcataaaagtgattgtataacttcataaatttactaaaaacatcaataaacttcacccctagaatgggttaatcatgtggtatgcaaattatatttcctaaccctgttttaatgctgaaacatgaaagttaagcaagggtttttaaaaatctcatttgtaatttcaaatcttacataacatacagtcttcttgatagccatgttaactcagtaatgaaaagcacagtcctagaatggctattcagttcctcagacagcacactataaaggcttacacttagtatatgacctttgctcaccttcacattgttgatttgctttaattcttaatcaaaatccagaggtgtgtattttatcacaaactaaatattcatagtatgtggactgacttccaggggtaaccacttcagggtataatactcaggtttttattactgatcacaatataccttttttattctctataataatttgaaaaataattttaattaatctcgtgtagcatgaattttcatgtgatatgcagaaaaacatcattgagcatgtttttctcatttatatactactcatttgtggacttatcacatcatttatttaatatttcacttaagtaaaatatttattaacatgcacagaccctgtacttagtcttccaaggaagaagctaatgatattatgccagaatcaatagtatcatttaataaaggaacattcccatacatcattttgggaggtataatatttgttattaactttgcaattgttgctataatactatcagcaaacatgtgacatatttactataaagatgcaattttaatgatgccttggaagcgctggtcttttccttgcctttggcaaaaataataataatttatattgtaaacattgtattatgtatgttctgacataactcaattggtttaccagagaggtgattgtgctttgtttgaaaattaaacaaaagttcatggcccaaattggcagggatgtctaacctaaaaagctctggggtaagttaaaaaaatcatcaatccaattaaatctcattttaaaagacttttatcttcataattcctatcatacttttctgttttgactgcttgtgcaaagtcatcacagttgctaattcgtttatctgagaatatacagatttaccttctacattggtaatatagtttagtttactatttgagttacaaatttatgagtggttttattttttcattactttcctattgcagtgatttatttcaagttttgtttcattttctacaaattgtggaaagaactcaacgtaatagtaacaatgccaactacatatttaaaacacataagcagtaacaggcaaatgatatgaatatattggctgaggggaaatgtagcctgttagctgaacatgttctgagacaaactgatcaacactgtcttctttttagccttgatagaaccttttgaattcaatgatttatagtatggtaggatatctatgaaaatggtaatcttccttttcaaatgtatgcaatgtatatgaatgcaactatttcattgtggctgcatctgaagccaccagactccttcttgatagaccacaatgatccactagtagcaggtagttgacaccttgagaaacactgcattaagaatattgttggtctccttttttttttttctagacacattcatatgacaagtgatgccatgtccaaagatctgtgggattccttcactagtgggagcagagaatagcccaagcaagtggcagctgtagtattatggttatacaaatgatgctacactaataaaaatgaaaataaacatcatttacaaacattaggtcagctatcaatatcacttcatttgtgagcacactgaagtgcttctaaactgcatgaaaatatttggcaatgcgaaagaaccaaaaagaaaaagtggttttgtagttgatacagcctgctctcacgtagcacagcaaatggaacaggaatgaactgagcctattgagaataagcaagtcataaacagataaaatatcactgaaatgccaccacaaacacctgtatagaacagcacatctaaaagttaatttctctgtttatattggatcacatacataggtcatatttagaaacaatagattgatagttatttttagagaaccacatagaagcaacctaatccaaaaccttcccaaagcatattgtgactaattcactatgtcctaggctatgccattgtaccttctataggcttttctgagcaatcacatccacatcaatctactccttaatttttactgctgaaaccctttcttccatgttccagacctgcattcccaatttgacgtcagtaagtcagacaatgttgtaatgtaataatattttaatagagatttcaatttcaatgccaaattcattaccagatgctatcaatagtctcttttgttctcagcacatttagatttctagtatttccatcccagttatcctacccaatttccttacatatcatctcatagcattgtgattgtgctagactccatacttgttattggcctccctgccttcatttttgtcaaatgtaaatagattttttgtctgcagtcagagtactcttcttaaaacaccattccttttaagtgatcaattgcctttacaaaattctacaatggttcctcatgggccattcttaacctccacactctttttaaataaattaatatatctatttattatcattattattattatttgtagaaacacagtcttgctagttgcccaggctggtctcaaactcttggcctcaagtgatcacatcatcctgtctcgtctttccaaagtgctggtgcaagccaggtgctccctgctgctttttcctaacttttaggatcatctccttctcctctgcatctacttatcttctgttaagccacaacagtcaccttccctaaacatgacttgtactacccgtattctctactttaaagctttactcacaacattcttcttgtccagaaaactctcacacattagattttcctatttaatccctacactcccttacatgatcctagagaagaagattttctatataatttcactagttttgcatttcactgctttgcctggtcacctgaaccatcctgtagctgccactccccagcagaggcaaaagattcagacattcaaacgttaagtataatatttctgctttccaggggtccaagcacagaattcaagggtctctgatgctaagggtttcaagaaggaatatctgcctgagatttttaaccatgtgtctcctgtcccggcagattgccactcacttagcaatcgcatccagaggacttttggagattttatctgttgttactcaaataaaatgccctatctctatctaaagccacactgctctcaaatctgtgtttacggagatcccagggagtgttgcttcagctgactttgctgtgatgattttgaaaaacggagatgggttcatttaggccaattaaggattttgagataaagggaaagatatggatatgtcagtgtgtgagctagtgttacactctgggttgtaacatattacttgtccatgtcatttttcattctatctgaaaactgttagaaattgaaataatgtatacacaatgataagcaagtgtccattttattaatactacagtatatgaaaaggatatgtttgtcaagaaagaccatggccaggcatagtggctcacacctgtaatccccacactttcggaggtgggaggatcgcttgaggccaggagttggagaccagcctgggcaacatggcaagaccccatctctacaaaaaatagaaaaattagccaggcatggtggcatgcgcctatggtcccagctactcaggaggctaaggtgggaggatcacctgaacttagggaggttgaggctgtggtaagccataattgcaccactgcactccagcgtggacgacagagtgacaccccatctcaaaaaaaacaaaaacaaaaaaaaagaaagaaagacctaaatacaatagagttagaagttctatctgaaagaatgaaaataaaacactgtttgcattttgatagtgccctctcaataccagctgcacgaacttgagaaaatctccctgaacttcacttctcttcagtggaatgagacaataatagtaacttgctcacagtagtgtgcagataattaaattaaaaactatttgtaaagaatttagcacaatgttactctcacacatagaaactcaataaataatagccagaaattttgttatggccacaaatttaaaaatcaagacactgctagctcagaaggtactgattggttataattcttacagagaaagctccaaaaatcttttccagacacctgcatacaccacagggatttcaaaaggagcagaatgataatataatataacaagggacaggtagagtatttttaaaatgaagtatataatgtgcatttaagaataaatttgtgataacacatgaataggtgcactaaaatttcattttcatgtcttattaaataaattgtattgctattagtatatgatttttatttccgtagaattaagggattatttctgagaatccaaatcaggagataactgaaaatattccttgagttatagatataagacaatcatttgatatgcaaaaattgcatatatttagaaaacctcagcagaacatcacaataaagctgttgtcattgttctgtttataagataaaggaagaaaaatgttctcgcttttgtaggcctttaaaaatgaagtagatgcagttattggaaatatgaactgactaagccatctaataggaattacacagtgtgaatttctctgacattttgtttgcagattcttagtagaaaagtagtggtttgtattagccttgaagatgttttaatcaaaggacacactgcttgtagaacaaagtgaataaatgtaaaatacagtttcattcaaataatgaaaaacctgtgctatagaaatttaaatctcatttaacttaaattacttattaagttacatatttataaattcactcatttttgtatataaaaatgtcaatgacatctccttttattctcacagggtttctaacattgctgatacacaagtcaaacttcagtgtctaatggaaaacaatttaggttattatttttcaaagaaaaaattctcaattatattagtcacatttataattacatggctagtcaaaaacattggagtctggataatagtaatgataataaaaacttgacatgttgttttttgacaggaaaagtcttctaggacagggtgttaaattccttaggagtgtctttttctcttttatagatctccatctttgctttccaggcccatcacactgtgtttttcccctgtaagtcagttcttcctctatctctgctttctaggctttctcccaaatgtcaattttcccctttactcactcccacttgtatttttactgtcagatgcttcttcacgttgatgccaaaatgtttttttttttaaaaaacagattttaaacattcccattttctttatacttgctaccatatcctcttttctatcactgtcttcagcctccctttttatgttttatctctttgtcaatttttttctaaaattttgttttctttttctactcatttctatgcatctatgctgtgataacgattaaggcaccctaaaaaaatgttaggctaataacatgatacacagtacattttttcagttgcaaaagacaactcgggggaaaaatgattaagggtgagagactcccactgaagtctatatgatgaaagtaacctcagatacaattaactatgagtatgagtgttcgaccatgttcctgactgaaatcaaacaggtaagaatccaatgaagtttgtgaaatatattgccaaaagcatggacgcaaagagattgggactctttcagacttgcaataagccatgaaacctcaacagtctgtgagcagaaagcatactgagaaaacatctctcaaaaatgacatgtattacgagatgtctacatcagatgtggccaaagaggataataaaacagactagagcaaaggaactatgaagaacaagtgaccatggagcccagactaaaggcttaatcagcttccgccacaaatctcacacttggaatcctcacaatagctgctcagcaggatttaagaattgctacactgggatctgctgggcaatgcccactcttccctttctgggaacgtttatttttgttaacttgttcctgatctgacatcgtatactgggtgagaaagagggcaggaaacttgttatttttgattctaggtctctacctctagaaaggccatatgaagaactaaagtagaccacttttatcacctcttgaagaagagacaattatcatgaggccagagcatctggactttgaccagtctgcacagaactcacagggactttaaagttaacaatcttgttaagggaacgagagtattggctgtcgtgtagagattaaactgaatgttttctaagcaaaggagctgactgataatcattagacatgttctccaatctccaataatctggtttttcttctaatgatttgtcaaatcttttcagttacattgcaaacatctttggaggaaatattatttattatgatacttatgtgattcacatcaccaaggaaaattccttgcataaatatggaacccaaccaatcccaatttaatttcatttgaatttcttttttaattttttttttctcaaatgactgcccaagtttttgagtaagttctagtgaagaacttcttgactttgcctgtcaagcaacacagaactctctttactatgcagaacatattccctgtggctcaagtagaaatatcctcatcaacattatctctcctcttctttcgcgtgactgtaactcaggccatttctgaaacaactgagacttgagtacatgcagggctggcttcatgggcatggaactggtgcagtgcaggtcttagccttcagcagggcctcctcacaatttaatgctcaactactgcattttaaacatccccctaggtttttctggtggaactggaaggtaagattgtgtctttccactacggatctggaatttcaggcagcaaatttccactaggtcgggagcatctgaggcaagcagatccaaaagtggaaagagaaattgaatccagaccatactgttgggacccagctagaaaagaatggactcaactgacctgaaagatgcaacaagtgatatggcattaatgatgttgttaagtttctaaatccagcctgatgccagaaacactcctggaccagtgaaatgagtgaatatagtctcatttcagtttaaagttacataagtgggattctggccatttgaatcccaagcaatcctgatcaaaacacattttctttctgtacttagtctaatatttttcccaactttccaaaactattcttgaatatgcctaaaaccaccatactttgcacaaaataggctctttcttagttaactcatattaaaaggaatcattaagcttgccataaattcactgctcaatacagaatgagcaatatgaaattaaaattgttgatatgtgttttaaaggtcaaaatccttttctccttttcttttgagtttttttatacttaatgttactcagagctatgcctctgcttttggctcaatattgattacgtacacctccacatcctcaaagaaaacaaaataaacctgctacatcctgtgccagggataactaatctaataataagaaatcagctttattttcaaatttttaatttctgtacataccacataaaggatatagttacttctgtctttccaatagtaagtaaatggaataaaatgaaaatgtatgacaattatattatgataatatgactaaagtattaagatgaattgttaatcattacttagcaaattacaactttcatatggagaaaataataccttacatatataatgaataatattacacttgggctaatatggttttgtaagttaattatagactacacagctgatttagtttcatttacctaaggagctgttctgaccctgttgcagattaattacatcttcaggaatacactctcatttatcattgtcacttggagcattatagctcttagcaagagtgtagaacttttttttaatgttaaaaaaattccttagctgtgatacattttgcaagtttagtcattaaaaacacatgacagctaaaagcaggtaagattaaattagctatggaacattgagaaagttcatgtcctagaaattaaatgactgaaagaaaataaaaattctgttaaaatcattcatgtcagacagaggcttcatctacatcctggagcattttttagaagatcccttgctttgaaatatgggtatgaaaaatgtttgccacattctaaattcttcagcacacattacacagctttttactattcccattttctataattgttagaagtatttaaaagaataacatcgttacctttatctatacctagaaagtattatttaaattatgatgggaaatttataccatttgcttttacctaatgatggtcatgtccttaattgtgaacatgagaaagagctaaagaagtctgtctagctttgaatactgtagaatatttatttacatgtgagtgatcatttaacatctgtttgagaactacgtgtcaatgtatgtgcagattaggcacacttgaataacttacattccttcacctggaggagctcagattataggggaaaatagaccaacaggtgcaactgagaaacaatgtgtaaaatgtgattaagattacataaagatatgcaacagttaatacggagtgccccaaatgagtggcaagcccagtttggtaggtcagaaaaggcttttggagggaagagaggcttccactaattattcaaaaatggacaggagctagccttgtaactcctgaatgaggaaaaggtggatgtaaagaggaaattggaggaaggagatgggaatggtcagtttcatccaaacagaattgatgataggagcaaaggaatagagtaaagtaaaagcatcttagaaactacaggcagtttctggagatgagattggagattgaggcaggcccagaacatgataggaagcttggaattcatctgtatgcaacagcagggccactggagccatgactagctatggggagcatgggtttgagaaatcaagactggaagcagagagagcaattaggaggcacggtgattgcaacagtaagaggtaatgagagttccagatacccaggggactatataaataaaaacagaaaagatttagagaagattgaatgataaaatgacaggatttcttggtcagtagtggggatttgtgaaatgctaagatcagttctagatgagtgatctagggcatgctgtcttctgcacagatggtggttgaaatcaatgaggaggagtgaaataacccagggcaatgcagagaggaaagagtagaacagaaaaacaatcctggtgatcatcagcaattaaaggaaaagtaaagttagaaaatctcttgaaagtgacataaaaccagcaaggtggtcagagaattataagacttgagagagtgtaaggtcatggatgcccaaggaagtaagaaaaacatttcaaaaaacagaaagtgagtcaagtgctgcaaaacactcagaaagatggtactattgaactggttaatgtgacatcaagggtgaccatagccaaagaagttttaggcatgtgataggggtacaagtaagtctgagaaaccagtttgcactggttctgcaaatggtgaagtggtaacataaaagaagttgttttacccccagaaattacctaggaataaatatttttttttaaaaaattgatatatattttctgttttcttctttcaccaaataacctatatagttattttaaaatattctatttaatactttgtattttttagaatactttatattaaatacaacatttactattcttcagaaatcagaaattctggttcagtattcaaaacccattttaaactttgttgagcgataaagagaatgcagggaacaataacactgaaaattatatttaagtctgaacatttaaaaacacagaaaagttatctggtgaaaggaaagacgattaaaatctctagctggctggacatggtggctcacgcctgtaatcccagcactttgggaggccaaggtgggtggatcacaaggtcaagagatcgagaccatcctggccaacatagtgaaaccccgtctctactaaaaaatataaaaattagctgggcgtggtggcgtgtgcctgtagtcccagctggttgagaggctgagggaggagaatcacttgaaccctgggaggtggaggttgcagtgagccaagatcacgccactgcactctagcctgctgacagagctagactgtctaaaaaaaaaaaacaaaaaactttagccattagttgcttaatgaacaagcaatttttgaaaatttattaataaaactaaaacagtaattttgttttattctgtcatttaaaattctagtttggggttttaagtattacagataaaaacaaattattcattattggttattatattatggatctgttttgaaaaaatcctattatattcaatttgctgcttaacatacaacttatttatcattcattagagattaggttaatttttttctaaaatacttatttactaaggagtttagtgtgacttacttaataaaacagaaacaaaatgtaattgaaagaaaatagctgaaattacatttgcaatgaaattttatgagtaaaataaattgctctgaggtaaaattatcaaatatttgagattaagaatctttttgtgattggtaatttactcaactaatctaagtcattctggagataaataacctgtttcagaagccaatgtcctattagaaagcatcttccaaaaggatatgaagttgattttccaagaaaaacattacagcagtatagcattaacatcattaaaaatttctttatgtcacaaaacaataaaaaatacaactgaggacattttctttctttcatgtgctttatagtcttcatttggttgctatgatcatccataacttgtcaatttctcaaatgtaaactccaatctcacttaagaaccaaataacaatgattgtcatgaacatgatgacggaattatctgcagaccaacagaattttatcaaaccaaatataaatcaaactaataaaaaatgacagcttctaaaattatatcacagtttcactaaagaggtagataatgtagaaataaaagaaaatgaaatttaaaaaagactttgatcattttcaaagcccaattatattcatctcacgactagacaaaaaattcttcctttttaatcagtctgtgagcattgctaaatttctttggttaaaatatttcctttgtgttttcagtaaagatataggagaatgtgttacaaagggctgaaaactggagaaattctgttaactatttccactaacttgaaatttatggttatgagaattaagtagtcatatttttcctacactggcagaataagaggctcttagtgactgactaaggctgaaggatattaaatcacaaccatgcaaatatctatttgataggacatttgggtggtaatatatatgtgtagtaaaagtccacttgtctttgtcagatttcttccagacttagaagatttctacagttaacatagacccaattctgatttcagaagaactaatgtggataaggttttcattttcatgttggctttcactttttacacagcatgtgatactaatttgtttctggatatgttctacaaaaactggaggacctttccagaagcctttacaattcttattgccttgcttgtttcttctcgcagtgctgacttctgtgttgaagagtgtccaaattggaacttactgggatgattaacagctgctacaaaatcaatactctatgtagggaaaacagaattgggctaagatagtcttacatgagcactattttgtggctgaatatctgttgatgtcagcaagccaaatacaatttatcttggtggaagcatttccatggatataatacaagagcttttcagacttggcctcagagacataagaggtggggaagataattcataggtcttaattgtgcataattatgcatattctcagttgcaaagatgatcactgttatactcagtaagaaatgggtttgcttaaatctttcattattttaacatttattatggttgaaacactaagtcatattactattgttactgcaatctgtctcacagtgagtcttaaattttttttcttcacaaattaaattgaaagataatacagatgtttgtggatttggtttattaagccctaatgttctaattacagaaccataaggtggtcactaacatatgacctaaaaatcttttgtatctctttttggagggctaaatatgctttataatattatatttaatattaaacaacaggataaatatgctaacagtttaaaaggtaataaacaattccctgagcccttacttatttgtatcacctctagccacatgcaagggaatatgcttgtgtgtaatgttttacctccaatatactagaattcacacttctttctggcaacatgttcatctttgtatccactataatgtctatgtcagcaattagacaatacgcatttgtggaataaactaataaatgaacttctctgtgattaaaatatcaaggagctaaatgctaaatgcccatgataactcaatattttagatttttatactaatgtaagtacactgtcagaagtagttaagaaatgtttattcaacaatgccatttgtaaagcccagtaagtgacccataaagagtatattttgcaaatctgtttaactggattatccactgggaataatattgtgtgctaaccctcctccctccctgtctcatgatactctccctatttcattgttgcacatgttgcttggataaggaatatgtcaccatgttttttatgtttttaaacacgaaaagctatcaggtttaaaaagacttaaaataattgttttccggggcagctaccatgaatttgactacacttttagcacattaagtaaggaatctgttttcctttctctccactaggaaaaattaaatgttttccaatagggagctatcacaaaatatggattctatagttctcagatgtgtggactttctaccaacatgttaaccagaaattgatcctgtagctcaaagccacaaggacaagaacatgataaggcagggtcagcgttgttatggaccgggaaagccacagctatcaataaaccagaaacctagaaagtcaaattaaagagccagtggtcttaaggctgatagtgacggctttgagatctttgggatgcttaaggcctaatccccaaaggggaaatcaaagataaagtcaaatgttaagaagcaaatgggaagaacaatacatgaaccagaagaatttgccacggtcagctcaagcagctcagcacagatgaattcattctacaaaatgaatctaataatgtattgcaaggcaaaaattattttccatctaacagtgaaataaagaccccataacatatgcacatgctttgtcactttcctttatagtaccctgtatcttttccttcaaaatactgagggctgtttgaaattcacttgtttattgtgtcccattcctaagaaaatgtagactaaatgagaactggttttccctcttgtgttctccaatactaattccgtttatcttctagtgctctgaagagtatccagcacatagtgattagtcacataaataaacaaaattgctatataagtaagtgaaggaaaggaaaagacacaagagtgtgtgaaatgaaaaagaatcagtagaacagcagctatagttatatctatccagttaaaatgtgatctaagcaaataaaaccacatccaatcgcaaatcattattaaaacaattcaataaaaggcagcactgtagaacaggttgaaagtgaatatttgaatgggaatgttagcatcatggtatgtatgggtttacaaacgtttaaatacattgaataatgctatgaaactttaaagattacccacagtcccaccacattttaaatttacattaagaagttttatttctctctgtctcctcacatgctggaggtatatatatttgcagattaatttatatgttttcatatacatattttgatatatatatttgtgtgctcctttacatgctttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcaaccgtcaccacgcccggctaatttttgtattttttagtagagacggggtttcactgtgttagccaggatgatctcgatctcctgacctcgtgatctgcccacctcggcctcccaaagtgctgggattacaggtgtgagccaccacacccggccttcctttacatgttttaggagacagctaggtaaagacatttatgtttgatcaccactgtgttccctaacatttcttgagcactactgttgagtgttgtaagagctttaaaagtcccgaacaactccttaagatagtttctgtattgtcttccttcacaaaagtaggatatgagaaataatgttatttatggacaatttgtttttgtaatttaatgttaaattttggggacctcttttctagttgtacattattttcaaattgataaatttttaggtttcccaactattatgtctttaaatatgctttgtgcagcttacacttttgtactcttttccctgtggaatagatttttagaaatgagatggatggatcaaagggtatgcacatttttaaattttaatagatactatcacataataaaatattttaatttataagcccattacacaatatggatgtggtgatttttctatttacatcatcatgtcaataagtatgacagcatcatacttactgatttattgactgatagagatcatcagtctttgtaattttgaacaatttgaaaggcaaaatatggtaacctattgcataattttatcgttcattgttaactaaaaatattagggatttttttcatctggctattcagtatttttctattacatgcttattttttaaactggaattcaatatttaagtttattcaccctatctttattatttttgttgaaaacattttttgaaatttaaaagttaatgagttttaatatatatttttaaaatgaaagatcaagaaaacacaaccataattaccttttagattctagatttcttgctggtctctgacaagttttcctgttccggatgatagcaatttacttctatattttcttctaatataagtgtattgcttccatttgtatttttaatctatttgatgtatatttcacatggctttgaagtagaaatatgaatttgtttttatttaaatgaataaccaattctgtcacttcatttattatgtattgtgcattttatccctctccaatgatttgatacttcaacatctaacaaatattaaatattctgtatctctgcactttgtttttgtctaactttatattcaattctattaatctatttttgtgccaccgtattttagttgcagaaatttggtagcatttagtacacggcaaggaaattgaccattgtaggacattatttcagaatattttaatggcatttttgttcaactgcaaattacattgaatcaaaaacaatccccagtgaccctatcagaattctcagaatcaaggaattaatatataaattaatttgggcagacttgatctcttaataatactgaatctgtccatgaaggaatgtcagaggcatttgaaccagagcaactccatctagaataggagtaaggtaaaataaggctgaaacctactgggctgcattctcagacagttaagaaattctaagtcacagaatgagatacaaggttggtacaagatacaggtcataaagaccttgctgataaacaggttgtagtaaagaagccggccaaaacccaccaaaaccaagatggtcacaagagtgatctctggtcgtcctcactgctacacacccgccagcaccattacagttgacaaatgccatggcaacatcaggaagttactttgaagggtctaaaaaggggaggcatgaattatccacccctagtttagcatacaataacaaataaccataaaaatgggcaaccagcagcccttggggctgctctgtctatggagtagccattctttcattcctttgctttcttaataaacttgctttcactttgtagtgaaattagtaatttttctaattaattatttcttgcaggagattcaagaatgatctcttggggtctggattgggactcctttccggtaacaggaatacaagacaaattcttaatattcaagccttattttataactttgcataaaattatttagatttcctcatatatgctgagtggttttttaactaaatgtaaaccttggcatatttttagttttgctggtattgttaacaaaattttattcatattaacataataactggtaatattaaaaaggaaagttagaggtttaaaaaatatatatttagtatttattacattgctttactagtttcatttctagttgatgaatatttattacatatataatcaccttcaaatattaatagctgatttctctacataaacatttaatttttcattattaaattagttcacttttaaaaatttgttgactgacatagtgagagaagaattatggtcttcctcctcattttatttggaatgcatcccctatgcccctatacgtgtattttgatttattaaaaaagcttaaatttttttcaattagtttttaatcacaaaaaacagcaactcttgtttttatttaaaacaaataattgtagtaatattgacccgttttggctttcttgaaataaaccctattgggtcaatagatttttgtccttagacatactacttgaatttatttcctattatttttgtctgctattgttgcatttatattcacatgtaaattttattttggaagctatggttatgaggtattgatattgaggttttcaatctatgtaaaatgaattggagaaactttcccttttaatctgcattctgaaattttgttaaaatataaaaactacttgtgctcttaagagtaaatggaattgccaccaagtttagtagttctcttactacctttctacattttccccctttggctaactgaaagcagtggttctcaaaataggatactggacaagcaacattaggatcacctggaagcttgttggaaatgcaaattctcagcccccgtccccaatctcagacctaccaaacagaaaacccaggtgtagagaccagtaatctgcattttaacaagccccttaggtgattcgaattcatgcttaaatttaagaaccactatcttagatgtgctaccgcttgctcttcagcaaattttagctatttatatttggatgcaaaatgttccatttcttctatataaaaaattattgccatataaacacagatgatatacttatttaaatattttccatagctgtggctatgtctttaaatttattatgctgtgtatttatttctttctgttaaaaaaatatttgtgccggtctatgtgtattctatttgtcatttttttaggggagaaaaaagctttgggctttgtctgtcattatacttccgctctttttttccaagttgttttctttttgtcaattgcatcttaactttctatttgtcttgtagctttttcctagttctttcttaatttgactattgcttatttttatctttttaaaaaaataacatcttcatggctataattttgtcctccatatacagttttgcccatatgcatattggcttttgatagaaaatcttcatatatttgttaacttgtaaataatactttttccatttttatttccattttacctaaaaaaaaatttaaatgatgcttatggaaattcttaaatttcttaattttttggtgttacttggtttatttttatttccaaatttatttcattgtcatcaaggaaattatcatttagactccttacatatttattatttattatggtatacaaaaattcttaaaattattttcctgcaacattggttgattattttatctcatttatcattcttaatgtttactattttgttcttttacttgtttgctgtaatcaaatttctaagatgttctttttcatagctctttttcaagaaattctttctagatgcatccattattggtcttatcgggaaacacatctccacatttttatctgtctctttatatatatctatatggttattatatataattgccatttatatatttatgataaatatctatataatatgtaaataatttagatatatatacatatgtataccttctgtatagaggatgactatatcataattacagcattgttagtaatgaattttctcttagtttatattatctttgtatctaaatttctgctataaatattaaattctttttttgttctagaaatgaaagtttataaatcttcttctgaggatgcctttcacaattttacattagaattgtatatttcctgtatagtttgccatttttcctttttatttcaactttgatccaataattaaccagaaatgttttacaattttcaaatgttaagatttttagaccaactttttgcgtacttgtaatatgactgaattatatgagatcaatttgcctttaagatttctgcttttttaaaaaaaactgattttccttgtggccacatgtgtaattgattttaataaattgttcatggatattccagaaaacacacatattccctaaagatgtaaatttcttggtatcttttgaaaatccaccaagccgctaagaaaaaccaagaggctgtatccagatgtctaagtgagaaactctactcacctgctcagcaattttatggctgttggagaccagaacactcctgtaggttcagtatgtttggctcttgtgtgcctcagatctgctgctttccagtccttacacctaggactccatttgcttactcaacccacttggggagaaatccctgcctgaagtacctcagctaaggctctaacaaagccaaaacatactagctcccagctgcccctggtctccagcatccatttgaatcaggagagttgaagcaattgaacaaagcagatcacctgcatgtccctattttcttagaagcctccaaatattcccctgggaaagcccacaggtgtgtgtgaaatgtgctaggatgtgttccctgtgaccaacatgacctaacaccatgtccaacataatggtgacttttttcaaaaatgtagaaatactctgtaattacatcaattttcttagcatatagactttttctatctctaaatttctgtagtactttaggctagaataacctataaaatcaattatttttccttgcagttttatcaattacatataccaagtttattgaagaatctctccctatgcactatatcatgttatgtctctaaagtcccagttactttttgctctgcagtcctcctacatcattttggaggaagggggcacagcgtagagggtaatggtctgctcattctgaactgaaatccctcaaaaaaccctctgtaaaggtagctgacctaaaatacaggcagtctctttagtatgcattcaggttgggccttagttctggggtaaaagcaataatcttatgcaaccttctattacctacagcatatgccccttagaggtaatggggtttatactatacaatttatttttagaaaactcaactactattgtcaattgaattttttgttacatcatgaatttattaaattatttcaaaaacttgatgcattgaaaataaaatatttagcagttgcctaatcacaatactaaagtcactgagatgtcaaagccttggatctcaaacatttgtgaacagagttgtgatagcagctatttagtgaaactccaggatgtcacttggcccctctgggcactgggctatttctaacttaagcatcttcaaattatttcttttttcttttcttttcttttttttacttttcttttctcttctcttttcttttgtttctccttccttccttcctcccttcctctcttcctctcttcttccctccctttctccctcccttcctttttgccttcctctctttttctttcatttaagtgtggagaaacatttattcaatcttctgcccattttgtaactaggttattagattttttttttactgtttaattgtgctaattacatattttggcgattaacccttgtgatgtagtgaaatatttatatttagtctttctcctctttttcttttttactttctcctctctttttttattgttgtaagaacacaacatcagaacttaggacttaacatgagatctaccttcttaacaaagtataaaatacattattgttgagtataggtacaatgttttacaacatatcactagagtttatccctctagctttactgaaactttatttatgtccgttgattaataattttccatttccccctcttcctagccctggtagccacaattccactcttcagttttatgaatttgaccattttatatacctcatataaatgcaattatgaagtagttgtctttctgtggtgggtttatttcatctaggataatgtcctcaaggttcatccttttagttgcatattgcaaaactttcttttttaaaaaactgaataacattcagttgtatgtatagaccacatcttctttatccattcatctgtggttgagcagttatattgcttctatatcttggctatagcaaagtgtgctgcaatatacatgacagtgtgaacatctctcttcaagatcctgatttcaatccttttagatagtcaggagtggaattgctgaattatacaacagttctatttttcattttttgagaaacctccacattgtattgcatagtggctataccattttgcatcccaacattatgcaggagtcccaatttctccaaatcttcacaatcacctgttgtttctgacaatagccattctagcaggtatgagatgatatctcgttgtgcttttgatgtgaatttccctgatgattaataatattgagcatttagaaatatatactggttcattatttgaatgtcttctttggagaaaagtttgttcaattttctacccattttgtagctaggtgatacggtatggctgtgtccccatccaaatctcaccttgaattttaataatccccacatgtcattggagggacccagtggaaggtaactgaattatgggagcaggtctttcccgtcctcttctcatgatagtgaataagtctcaggaaagctgatggttgtataatggagagttcccctgcacacactctcttgcctgacaccatgtaagatgtggctttgttcctccttttctttctgccatgatagtgaggcctctccagccatgtgaatctgtgagtttattaaccctatttttctttataaattacacagtctcaggtatgtctttattagcatcatggaaacagatgaatacagtaaattggtaccaagagtggcgtgctgttttaaagataccccaaaatggagacgtgactttggaatagagtgacaggcagaagatggaacagtttggagggctcagaaaaagacagaaaaatgttgcaaagtttggaacttcctagagacttggagggctcagaagatagtgatatggacaataagatccaggctgaggtagtctcagatggagatgagaaacttgggaactggagcaatggtaactcttgctatacaaagagattggtggcattttgcccctgccctagagatctgtggggctttgaacttgagagagatgatttaggatatctgaggaaagaaatttctaagtggcaaagcattcaagaggaagcagagcataaaagtttggaaaatttgcagcctgacaatgcaatagaaaataaaaatccattttcgggggagaaattcaagcctgctgcagaaatctgcataagtaacaaggagcccaatgttattcaccaagaaatggggaaactgtctccagagcatgcgagagacattgtggcagcccccctcatcacaggcctgggggccttggaggaaaaaatggttttatgggctgggcccagggcccccctcatgtgtgcagcctatagacttggtaccccatgtctcagctactccagctgtggttaaaagggaccaaggtacagctcagaatgtggttccagagggtgcaagccccaagccttggcagcaagctctaagccttggcagcttccacatggtgttgagcctgcaggtacatagaagtcaagaattgaggtttggaaacctccacctagatttcagaggatgtatggaaacatctggatatccaggaagaagtttgctacaggggtggggacctcatgtagaacctctgctagcatgcagaagtgcataagggaaatgtggggttggagcccctacacagagtccccactgggacactgcctagtggagctgtgagaagagggccaccatcctccacaccccagaatggcagatccactggcagcttgcaccttgcactggaaaagttgcagacactcaatgccagcctgtgaaagcagccaggagggaagatgtaccctgcaaagacacagaggtggagctgtccaaggccatggaagcctatcttttgcatcagtgtgacctggatgtgagacatggagtaaaaggagatcattttggaactcgaaggtttaatgactgccctatttgattttggacttcccttttgttttggacgatttctcccatttggaatgagtgtatttacccaatgtctgtacccccattgtatctaggaagcaattaacttgcctttgattttacaggctcataggcagaagggacttgccttgttttagattagactttggactatggacttttgagttaatgctgaaatgggttaatactttgggggactgttgaaaaggcatgattgtgttttgaaatgtgaggataggagatttgggagggaccaatagtgggaagatatggtttggctgtgtccccacccaaatctcaccttaaattgtaataatggccatgtgttgtgggagggacccagtgagaggtaactgaatcacaggggcaggtctttcccatgctgttcttgtgatagtgaataagtgtcaggagagctgatggttttatgaaggggaattctgctgtacacgctctcttgcctgccaccatgtaaggcacgcctttgttcctcttctgccttctgccatgattgggaggcctccccagccatgtgaaactgtgagtccactaaacctatttttctttataaattacgtagtcttgggtctgtctttattagcggcatgagaacagagtaattcactaggttattcatttttttactatttacttgtggaaattacttatactttggagattaactcttgtaatgaaatatatatttggttttccctgtttcttgacaaaaaacttctaaaattcttgaaatcttcaaagtggtaagtgccattttgtctgttaatgagttgacagaattgagtgaattttttagttcaattattgttttcttccattccatgatttctatttggtaccttttaatattttctatctttttgttgaaattctcactttgtttatgcgttattttcttgacctcaatgagtatctttataagagttattttaaattatctgtcagataaatcatacaactctgttttttttttttttttaagttggttcttggtggtttaattggtccactgttgggaatatccttgtctactttttcatttttcttgattctctatgtttatgtaatctgcacattagacaaaacattcacctctccctgtcttcacagactagccttgtatggaaaagacccccaacaactagccaggtgaaatattctggggtcttcaccaagttttccttcctcagagaaaagcaagctgctgtagttttcctgctcactctgtgctcagccaggggaatgaaaaagctatggtttctgctagcacaagccaccatttctgttctcctaaaggcagctctgtgttagacccatcagagtttcaagactggtaagacaaatgctagctctttgggcagccctggagaaatttgtgtgatgaactcatggagctactttttatttaagcaggcagaagctgagagctgaaaatttttgtctgcttgctctgtgctgagcaaggggaaggatcaatggtatccattagttaagccactgcctgtattctcccctaggtggctggttttgctgaagccattagtgttccacctggaaagacagaaactagtcttccagggagataccttggaaaagtggaagtgctggacattcaaactaacctcttccttcctctaagtaaagctgggggttgagggttttcttactgatcatgtgatgctgtgcctgggcctggtcttcagtgagagggtaacccaattctccctaccaacttaaatgagtctggttttgcattatcccagggtacagtagcatttcaaagattttcagatttctcacaaagggaattagtctgtaaaagatttctgaagctatatgtttgtcaggggaagaagatgtaggtcttcctagtctgccatgttgctgatatcactctggttatttgtattttaatattaaatggaatttaaaaattcctcttgaaaatttcttatctctgttactatatagtctttatagatgcatcttcactggcccaatttcttcagttttgtcctgtttttaccagacttcttagcagctttctatttagtcggccattcttttcttaatctttttttttcttttttgcttacctgaacattatatactttttgttttcctcctgcttcattggccattgttttccagggcatttcccatgccatcttcttctagtagactctaggtattagtaaacctcaaggctttatcctaaagttccatttcttctctttttgagctctccctattaatctcgtcagtccacactgatttaagtatatgtttaggtagatggaaaataatggataaactttctcccattcctgaatgtccccttgcaatgtaactgtcttccgtcaagaggtagattctatatcttctctccttgaatataagcttagttatgtgatattctttggctaatgacacattagcaagctggatgcaaacagaggtttgcatcaagaggtttgcattgggctttaccctctttttctactgaaaatttttccaccattatgtaacaaagtctggcttaacctgttggatgctgggagtcatatggcccattatcatcatcagcctactaacagctagaaccaactgccagatatatgagggagaccagcatagaatagctccaggtaatcttccactaaaggcacaaccacccagttgacacacagacttgtgaataataaaatggttagcatattaagccactgaattttaggaaggtgattcataaagccatatagaaataaatatgtcaatgactccaaattctccctaagtgagatagtcttctaagcttccaacttaaatatccaaccatagccctgaaatttccactatgacatgcacctcaaactgagcatgtctttatatcctccactaaacctgaatcataaataattaagcccatctcagtaaatgagaccacctagttgttaaacttaaaacctcaggatattttatttccttccatcccctggacactgtcgattttattttcaaaatatttcttaagtctttccagtttttttcagtatccatggctcttagtgtactcatctgtctcttattttactagaagatattctaggatggtctctttgcttccattcttgaaaacttccatgtcattcgccatgtgaccaccagaatgatttttaatatagtaatttttttaaaaactgagcttcctttaagtgagcagccagattaatattttttcttcataaattatattgaatctgaatattgttaacagactattgtctagcaaatctgcacatttttctttttagtttttgaggtttatgatgaccaagagtcgcttgtgttgtttccaaacctgtttatgcctgttttactttccattatacttatataatttaatcacatataattggaaagtataattttaaaaagaatcattttatagaaactaaatcaaatgctttaggaagatgtaatataaatgtaatgctgaaactttgctgtataattatatgtaagggtaataattataaaagatttttaaaaacaattttaagtatctagaaggattttactcatatggcttcacaagtgtcttctgagtttttactctaaataaactgaaactgaaaataatagatggtttattatggactgtggtttacacaaggcagagtttatagaatctcagtgactgacattcaaaaataagacattggctgggtttatgagggaagatggccaattcaattatatttatagattttaggtagaaagaaaacatttaaagttgtttgtgtcatttttatgacaattgttttatttttcaattaatatccaactatcacctttagtagaagaatttctgctgcaaatggatcgggttacctcattccctaatgataattatttaattattcagtgacctaccacttaaaaggcaaatatcacaccatagtcctacaggagacttcgagacatggtggcagctgtgttaacagcagcctttcatgttactcactccccctatccctctccatgctccaggcacattgacctagcagagctttgaaggcactaagctctttcttacctcaagtctttcacatacagttatacttgcctggtatgctcatgacatctctttggtgtccagctcacttatgtatattcttcagatctcttcttaaatgcatcctctttatataagcctttcctgactctcagatctacggttgatgtccttcatggtagcttttgttttctttcacagcatttatcataattttcaaaaatgttgtatttgtgcattggttttttgctttttaaaaatatctccttgcatcattaaactccaagttctaataatgagatgacctgtatatatatatataaaaaattatccatttatatatatgtttatatatattatataaatatataattatatgtttatatatataatatacaattatatttatatatattatatataattatatatttatatattatatatattatatatttatatataatatatataattatattatatatattatatatttatatattatatatataattatattatatatataatatatttatatattatatataattatattatatatattatatatttatatattatatatataattatattatatatattatatatttatatattatatatataattatattatatatattatatatttatatattatatatataattatattatatattatatataattatatatttatatattatatatatttatatattatatataattatataattatatatttatatattataattatatataattatatataattatatattggataattatatataattatccaattataaataaagatatatatatatatatatatcttttttattgagatggagtctcactccgttgtgcaggctgcagtgcagtggtgcgatctcggctcactgcaacctctgcctctcaggttcaagcacttgtcctgcctcagcctcccaagtagctgggactacaggcatgtgcctccatgcccagctaatttttgtatttttagtagaggtgcggttttaccatgttgaccaggctggccttgaactcctgacttcaggtgatctgccttccttggcctcccaaagtgctgggattaaaggcgtgagccacagcacccagccagatgacctgtgtctttaatttactcccataaccctagagcctgaaaaaaataagtgcttagtttttttgtttaattaaacaagtgaatgaagaaacaactatggaaattaaactaatggggtagaaagttttattcctgggatatttaaagatatctgtagttggcttttgcttctaatgtccatctgtctagcatctcatgacaatcttctttcacctcactgccatgtaagcttagtgactatacagacttctatcattttcattgctaatcctcaaacagtacctggtacatagaaggtactaaataaatatgcttttattgatggaccatcactgtggaagaatatctatttttagagttaattatgatttcaggatcatttccgatagttctggctaaattggaaaagcattaaaaagaaggaattgccatagtgtctagttattgatcaatttccctttctacctaggcagacaaaatttatttcctcagctttcttacaattatgtgcaggcaagtgattgagatctggccagtgagttatgagtggaaatgatgctacatcttccaggtatgggcccactaaaaaaaatccactttctttagccattcagttgttgaatagagaaggttatctgtcaagatggaaggagcctgggtcaccgattgacaacatagagcagagcctctccccaatttttaacctatcctgacctgtcacgtgaggaaaaactgatttttattcattgtcagaccacggataatttgtaccagcagtcaacccattctgaataatacaaagggtctataacaatgaatatgaaggtgatatagctacatatttctgacctcgggctttctaaaaattggaggcaaggttctttgtatattgtacagcgctagctgtcagtaaataagggacgatagttgaaataatgaaaacaatactgagattagaatcaaacttggaaatcactttgtaactagacagcagaagggttcctaaagacaatttcaagtacaaactacgtgctcatctgaagctttttcatgctgttatagcataaagttgagatgcatcccatatgctttaaatccttcaactccactatttgttatatattcaggaatgatttgagacaatttattttatttcattatattctagattcattgattgaggaagaggaatgtaagctgctgagtagatgactttgttgaatgacattcaaggtagaagatctattgctctgattatgtccctgagcattgagattttgtgtccctggggcaggaataaatctttcagggaggaatgcctcctctctttatccccctaatccccatattatgctcaggtaaaggaggcccaagtcaaaggaaacaagaccctttaaaagaaaactcagtcaaagccaccttatttgtttaattagttctgatctgccttaaaatcataaacattctatcacatagtttttattagtttctaaatgtcatcttttaaatttagatctttaataagtctggcgtgtacttatataatatgaggtagagttctaacaaaagttttttctttctaggaagctaggtttgaacattatcaactaagtaatctgccatttcctcagtgaatttttgtgccatccctatactaagttccaatatgtgtctctgtacttcctcattggttcattcatctattatttcataggaccattctgttataattatccaattcaattgtagcatgtataatttagtaaaacaaatttatttctctccttattgttaaaattgacttagctattttgtcatacatattttaaataagtttgttataaaatccagctccaatcttgcatagttatatattaaatgtataaattaattgaatattatatcaagaaatctcatataagaatagaaaatgtctccatttattctgatcttgtgtgtctttgcagagagttttaacattttctttatataggtcatgtgtattttttattaattcttagatactttcaatttttttgttattgtttctggaaagtcattgattattgctaatataagcatatactagtgaatatttaagttgattttatatttggcaaatttgctataatctcatactagtcataatatattttcaattaggtatatattttttcaattggaatatatataaatatatatttatcattatttttattacttttttaaattttttgtttttcaccatatgttgtttacttataattctctatagagtatttttgcaaagtcaatttttcaataggtctgattaacttttctcaataatgcagctttcagttttgctaacattacgaatttttgttgttgttgttactctctgccattttctgtctcatttctattatagctttccttttcaagttttttggttttgtatcatttctctttttcaaacaccttgactttttgtatttaaatacaattgacccctgaacaacatgggagttaggggtgctgaccactcttgcagacaaaaaaattggagcataacatttgactacccagaaacttaacaactaatactctactgttgactggaagccttaccaataacataaagccaattaatatatattttgtatgttatgcatattatatactgtattcttaccagaaagtcagctaaagaaaagaaaatgttaagaaaattataagaaagagaaaatatatatactattcattaactggaagttgatcatcataaaggtctttatcttcatcatcttcagattgagtaagttaaaggggaggaagaagagaaggggttgatcttgctctcccagaggtggcagaggcaaaataggtggagaaggtaaaaggggaggcaaattacactgggtataacttttattgaaaaaaaaatcgataagttgaccagtgccgttcaaacctgtgttgttcaaaggtcaagtgtatttctgtttcctaatataagggttttacaacctcgacactattgacattttgagctgtatagctgtataattctttactttgtatttgaggtgttgtcccatgcagtaagcgtatttagcagcattcctaactttacctactagttagcaaaaaaaccctgctttagtcatgacaatcaagcagacattgccaaatgtcttccaggaagaggcaaaattctcctctgttgagaaccactggaaattgaccaaagcatataaaaaaaatgagaaatgtttatttaggaaaaactactgagcctcagataagaactctctaattagtgatatttcagatttgggttgcttcattagccttcagctccctgggtgctgtagttctatcagagtggaataagctaagaaaacaagtagattcattgtcagtggaactgacttgatttgaaatggaagccagaaaatctctatggcctagaacattgttttacaacttacacttacagtagtgatatctgtggcaaatgaacagggagagccagtgtcatagctagcctgagtttgtgaaactgactttagggccagcagctaaccagcagattggccagagatttaacaagagatctcggaatcaaactttcatatgggctgtgataaacttctatatattcctggctgtctgaaaatctgtatggatttgcaaggctacacaaatgctcagaagagacaaaagaggatcctagttatctacacatccttggttaaatgagaggttttgtacatgagcggaagagacgaaagaaaggccagattatattaaaagccgaagtgatttctaattgcctgaactttgaatgtattcttcagtgaccatatggatgcgatgacaaagaaaagaagacttactggctcaaagtgtttgagcgcaatctctagacaaccattttgacacaggggtgatctctaggaaagcagtatacaccataagaaagaaaggctccacaggtaagtcactaaatagacaaacataggaacaatgataaccactgtgggcagataaaaatccagagaattaaagatataaacaattttcagtattcaacaaaaaacgaggagatatgcaaaggaataggaaagtgtgtcacacatttagggaaataacaagcaaacaaacaaggtctctgatggggcacagatatttgacttcacagacaaatacttccaaacagatattataaatatgtcaaaagaatgaaaagaaacaccatttaaagaataaagtataggccgggcgcggtagctcatgcctgtaatcccagcactttgggaggccgaggtgggcggatcatgaggtcaggagatccagaccatcctggctaaccccgtatctactaaaaatacaaaaaaaaaaaaaaattagccgggcatggtggcgggtgcctgtagtcccagctactcgggaggctgaggcaggagaatgtcgtgaacccaggaggtggagtttgcagtgagccgagatcgtgccactgcactccagcctgggtgacagagcgagacaccatctcaaaaaaaaagaaaaaaaaaagaataaagtataaagtatagtaacaatgactctccaaatagaaaacgttaattaaagatacaaaattataaacaaaagaaccaagtagaaattctggagttaaaaagtctggtaaccaaaacaaacaaaaaatcctaagagacttaagagacaggcatcattaatatctaaagattggaaacaatcaatatgtccaccaattggtgaagggataaccaatatttgatacctccatgccacagaatcctattcaacagcaaaaagggaaacaatatttatacagttcatatgagtgaactcaaaaacttcatgctaggtgaaggactccagatgcaaaactcctatattgtgtgattttaaaaattattttcccataagtttttggggtacagtggtatttggttacatgagtaagtcctttgtgagattttagatatttttaaatatagaatgtccataaaagacaaatcttagaggcagaaagccaatcaattccttcctgaaactgggaaaaagagccaagattgaataaaaatgggcatgagggttctgatttgcgtaataaaaatgttctaaaattggattaatttactaaaatcattaaaaagtacacttacaatgaatgaattaggttgtgtgtaagtgatacactaagaaagctgttaaaaatactgtttttataccaacgtgaataggagggcttctctggatcaagacacattgcatttttctttcaaataataatagtcattacagtattagtaaccattgtatatttagccttcatcatgtaccactctatgagattctttaaatgtacaatcatatttgtaactctatgagagaggaaataataaccagcatggcacagataaataaatagatactgagattaaataatttgcttaaagacttttacccaggtagcttacctcttaagttcatggactcaaccaatgctttctatattctactagcctttttataatctatctctgtgtgtgtgtgtgtgtgtgtgtgtgtgtgtgtgtgtgtatgagatgtgacatgacataaaattagcatgggatgacatacattaaatttaatgtaatgctttattttctatatttttagatttcataatcattggctaaaaatatatataaaatcactattaaaattattcctttaggattaaaattttaataactatttcaactgccatataatattttactctgtgtaagattctaaaagaaatgaaatgaaaagccagccttctgacttattaatcacttgagaatagtagcaggattttttgtagacttttcatagatttttagtaagttataatgattttataaaatgcatctcaaagtaagataaaatttaacgcaatattttcacattttcaataatatggagttttagcttatactctaaaacttgtaagtatattaaatcattctaagcttcattttagtaacacaaataaaccaattacaaagaatatagtttttttcctttgcttaagacatgaaaaatatgtcaattgctgatactctgacttcaaattggtaagcgatgataataatgatagtcattagagcaataataattgcctattagaagagatgttttgatggcacaaaaggtaaaataagttatttataatcagtaaattttcatagtttaaaagttttctcactgtgattatacagtacaggtacaaaggtaaaatttagtggagaatcttaccacgccaatggaaaagtaattattgatgatactgtaaggcactgggtctcctttctcatctttgtcattaggtatgacttcaaacttccacctgtccaacatgatttctgtgctgttttcaatgtcttttagaattttcatcagattctcaccttcgtaacctagtgggaaaaaaaaataccttgagaaaagaactctaaccaaataaaaaagctgtatttttatgtttcagtgtgcttatgcatatgtaatattctaaaggtaaataatgattttgaagcacattctgccaccaaatgaagaattaattataagattatactcatacccacatttaattcttaactttaattggtaacatgtactgtatttctctttttgtggtgcaaattctcagcatatacaactgccaagtgaacatttctactgtattccccacaaaactttataccaatagattcaaaactgaatgaattctctgcttccatatcttcctcctgggcagctgacttcacaaagacaccatcctctacccagctgctaaagtcagaaacgtggatgacattttagacttttccctttccatcactctcttaccctcaccttttcccgtctagtgatataaaactttcaatttaagtaaaaggtcctactttttgtaagctttaaaatttcgtttcttattctgtctactcagggtgtcccttttctttttggctggtttgcatctatttctttggcattgttttatatttgctaatactacttcccagtgctgctgcttatgcctgtagtctcagctactcaggaggctgaggcgggaggactacttgaggccaggagttccaggctgcagtgagctatgattgcaccactgtatcccagcctgggtgacagagtaatattccctgtttaaaacaataaaattaaataaaactaataaatttgctaacacttctttctggaaagcaccctttcaaaataatggctcagatgcccctctcacagtccgctatacgcagttctcaaaactagccctatcttagaactagtacaccacattgtcattacttgtgtttttctcactacaggtccctcttaacccagcctgcaatagagtaaatgctcaacaaatcaattttttaatgaatatatgatagacggtcaacatgacctgaaaataaaagtcttgtcaatattacattctcaatattcaatttatttgtaggtagataacattatagttatcactgcagcctaaccctgacagagttactgtttttgtttctgaatcttcctcaacattagtttccttccctgtaaaaaccttagggttcttgtgaagattaagcaagataatgcctaaaaagttctcagtacatgagtcctaaaacagagaataaaaagttctcagtaatattttactactgatgatgataccatcagaatttgaaatattgtactaagttaaatcatctctcttttcacccacacaaaagcacacacatagtcctaaaatgattattttgagtcggaacaacattttcagtttttatttttttctgttcattatttaattgttgaacaaggaaatgccagaggctatgagtcctcattagagctattagcatacatatcattgaataaactcattgggttaaaagaaaacaggcactctcatataccaaaattccctaaagaggaatacgttacacttaaggtgtatctgttcaattaactattagaaggtgaaagccaccagaaactagaaatacctcttctggagctcatcatcacttcttaccttacacaggtttaaaaagtaattactcgctacttaatacatacagtaaagggtacaataagtaacgattacataaacattgaaaatattaaatattatttcagaagagattgggtctattcagggtggtatggccatagactaaatactatttaaaaagctatcatatattttacagtataatttgaagctgttaagtattaataatatgcatataactgtactcagtggcaaaacactgaatggcttaaactgcaagattacaataattatatttactaacatttcatgtttcttaatagtgctaccttattttaaatgtttaattaatttctaattgttaatttcttttaagaagtataagtaatagctccccaaataaattatatacatatatatattattttacctactgaattaagtaaaaaacacttaaatatattcatctattttccaaattctgctttcatgtcagaataagcttgatagtctctaggcataaattaatttgcatataattatatattataatataggagtatcgtgtgtgtgtatgtgtatacatatatacaattagcagaaatactagtaaataataatgctttcaaaaaggttgaattttttctcagtcatgtctcaggttaatagcagcaccgtccaacataacactggaacaatgtaggaacagcaacctaaccgggagagaacatgataggaatgaatgtagtgaaaatcaattaccacatctagattgtagcagggtcacgcagcttaaaatctttaccactggatatgtgtgtagggatttttatgactaaacatgaaaaaggctggtttaaatctgtcttctagccaagcaaaagtagaaagaggcaataaataaatcttgagaattacaacatctgcaattcagaagtgattcacatagataaactctgaactgtagtcccccatttaacaaatatcttttccctacttcttgtatgtatctatgcccaagattgttaaataatgataagtaactattaatagggttcctgtacccaagaagatcatgattttaaaaaagacaaatcaaatccactaaatatgccagcaaaagatttttacagaaaagaataatgctattttactttcattattttggtttaaagcctgtaatcaatccaggctaagaaacaaaatgaaaacatgattaatatttattttatatttaatgatattatgttataatgactgaatctaaaaagtcatagaaatttttgcaaatgaaaatcacataaagaaatgcaacaacaaatctgtataaaagtgtgttcaggccaggtgcggtggctcatgtctataatcccagcactttgggaggtcaaggcgggtggatcacgaggtcaggagatcaagaccattctggctaacacggtgaaaccctgtctctactaaaagtacaaaaaattagcctggcaaggtggcgggcgcccgtagtaccagctactcgggaggctgaggcaggagaatggcgtgaacccggggggcggagcctgcagtgagctgagattgcgccactgcactccagcctgggccaaagagtgagactccgtctcaaaaaaaaaaagtgtgtccaatttacaactattacttgcctccttattctacacaaacaagattttccttgcaattaaatttttgttaagagagactaatgattgccagaaatttacaaaaagaatgctaattaagctagaatatcctacattcttacagtgtcaacttttccaaaatatgaaaatatattcctataaaaaagaggcttcaagtcaatagattccctgaatcttaagtgaaccaaatgattattggttgaatgaagtactttcttctacaaatattaagcataataataattactgcaactgcataaagtacttaacacaaacattgatatggtttggctctgtgtccccactcaaatctcatttttagttgtaatccccataatccccacgtgtcaagggagggacctggtgggaggtgattagatcatgagggttgtttcctccatgcagttctggtggtggtgagtgagttctcatgagatctgatggttttatcagggactatttcccctttgctcatttgcttctctcacctgctgccatgtaaaaaatgcctttgcttctccttcaccttcacgattgtaagtttcctgaggcctccccagccatttggaagtgggagtcaattaaacctttctttataaattaccgagtcttgggtatgtctttatagcagtgtgagaacaaactaatacaaacactgtgcaaacaagttatcggtttagcacgagaacctacaaggcactgttattttcttcaaattctgatgaggaatctacagcacacaattgttaagtaacttgctcaaagttacacacctgtcaagaaataatcccaccgtaaagcatatttctttgttaataatctctagcaaatggcttctccatttccctaattgctcaacttgggcatcttgataccttgctttccctaaaattcctaaccaatccactggtaagtacaattaagctaagcctgaaaatgtacctccagtttggctacttgcctgatttaaatcatgtaagctctagtctgctcactttattatgcaattgggacaactataatagaagttctcatttggagaactatagttctgcatgttttcacattttctgaccagtttattttctacccccaaattaatctgtttttgaaaatgtgtcagtgtgttactctgcttctgagactttcgaagcttcactttgcatgacaaattcaatcaagtaaaactctcacaatgacaaataggttcctgcattatctggctcccaattgtctttccaaagtcatagtactcactatccctaattgcccaccatgcactgctgcttcagcaaccccacctgcattccttccttcagtccttgaaacacagggagctatttctcctccttcttatattttaggtccagttttaatgttacctcctcagagagaccttcttggccatctagctagatagttcatctctattattcattcttctgattctttgatattttataattatatatttcattattgttcaatttattttcaattatactcaacgaaaatgtaatctccagaaggatagaagccatttgtttatttcctcactgtatatttagcacctagaacagtgccaacacatatcagacactcaaagggaattcatcactaatagattctttgacacatgctacagtccttgcctttgtccattgttagtgctttgtatgtggtttcacaagaattattagagtatgccaaatatggacttctttaacaaatttgagatttaggccatttgttaatctggaagcaaaaataaaattattaattttcatatacatcaaatatatgttccaggagaacatggcaagaagactcacatattttccttctttttaatctatgcacttgtatgaacactggcaaatacaagtatcttatcagaaatggtgatgtctttattcatttctttagattgcatgaactctaatgcaactcatgaaaatactcctgaagtatattcttactgaacatcccaaatagactacatactaagctcttgacttagtcaagcacgtatacagcttagagctagttggtcagatattcatggaattattctccaactttgccgtaaatcagagttacttagggagtttgtttaaaaaaaaaaatcatctgctcaggtcccaattccagatatttccattcagcatgtctggggtggggtcaggccactgtatttttaacaagtgccccagggactctgttcaccttgtcttagtagacacttttcaaacttctctaagtgagctttgatgctaaaaatatttagcattcaagtcctgcttctttaccaaagtctgatggtgtttagtgatcttacctagtggtgttcagtgatcttcagataaatatagcctattagtgactctgcaaaatgttttaagacctcatctccaaatattctctctttgcttaccctactccatcgacactatttcagtttcagttccttgaatatgtcaagtgccttcccacctctgggcctttgaactcaatgttccctccgcctatgaagttcacacccagctttacatggctgtgtcattatctagctagcagttttttcttctatgtcatatcctcagtgaggtctttccctataatgatcatctgtttacttgttagtgtaaggtctcacatatgattttatgtgccactagaaatcaaggtacttttgtttttcttttgtcaactctgtatccaaagtgcagagcacagctggctagcatagagtgagtctcaaaactgagtattatttaacgtattcactcctgggaaactaattcattagcctttcatctttcctttgtttgtgattttacctcccaacttataaatgaaaagtataaaaattaccttgaagtgcatccatgtgtaccttattttctaaacaaaaaaatcaaaaaccaaaaccagagatgtttggaaacttgacctcctttagtttaagtctctatttaatatcacattaaaacccaatacccatggtctcttttttccactatttgttcttctatccaagactattgttcaaaatcatatattatatataccacatcagttatcttcactgaaatcatatcgtttttgtttcttttcttttctttttgttttgcaagggaaaggggtgttgtgtactgtttctgcttttgttgttgcagctgctttacctcctccccatcgcaggcatcttgctagatcattgccagtcccaagaggcagaatcgcaactggaggatgcttgcctacattggccttttctgcagaataaaaaaaaatacaaataaagaaaattttaagttcagataaaacgacggaaataaaaagatagcctgatgacattaaatgaaggaattccaataggtactcataaacaaaacataattgtagttttagatatacacaataatgaattatggataatttgtatacatttgtagcaattgataagacacaaatactattattcacggaatgatggaattttcaaaactcaggcaagaggaaagctttttaaatatcttaactcagctaaaaattgtggtgtgtcttatctccactacaatcctcagggatattattatatacagcataagattacaatacagagacacaactaggatggatgggtaggttcctacataaagtccttttgcaacatcaattctaggtacattttacttaaaggaataaaatatttgaaaactgttgaattataaaagtgagtaaattgctaacaatgtccttgactttttcccacccatggtgctgctttgtgtcagagcaaatggaacacaacgttaacagctggaatacaacgagatcagcaggttttccatgagattaatctttacatcacataatgctttgggttcagagcagtaaagatctctgccgctgacatcccatatgctttggtttgaatcattgcatgccttgaattaatctcacaaatgtatatcactttcttttatttgtttcttcctccttagcccctcaaaatcagtgtacatatgtgtgtagggatagaggggatagataatgtagggaaatgtcacaatgaaatagccgacaataagatttttgagggctaaaacaagctaagaattcctgctgtttttcctctaaaatccttacaagtcctcagatacttttccagctaactcattaacttttgtaattcttgaattctggttgtcttctcagataaaacatataaatatgatttacattgtttaatggaaggccagatcagaattttcactgtttctttttaaatcaaatattagtagattaaagctgttagatccttatcaaaagtgttgccaacatgtatttttcttattttgaatatttttagtgtatgcatagacagaatgttttctgcattgactaaataggtgtctgtttcaatttatacagaaggtaaaacttcttttgaatcaattcgttttatgaaagggcctgttttaaacaaagaattgatcaatgcggtaactgaaatgagaccaaaaagagtcaatatttgttttggatttatttcctcataaaggccaattcatggtctctttttctaactagtaaccagttccaacaactgactagatctgaaaaagcaaataattttcctgaatttatactttttcttgtgctgcatacttaccttatatcctcagtgatgttcctgtattatttgctcataaaaatcgagcgttttcagtttaaatagagaggcaatatagaataaggcttaactgtgcattctaatctcagctctctcagttcacagctataagactttgttgtagttatttacttttttccaagttttaggttccctatctctacatgggattattaatactatctgtatcatagagttgtgaggaataaacaagataacatgatgaataaaaattagctatgatgatgatgatgatgatggatgataacgatacaaatgtatacagagggtaaggttttgagggtccatgttttaaaaacgtaagcacatcaatttcgcacagactttatcacaaatactaagactgctccttcagttccttgtctggggcacacaaacaatctgatttcctagagcccctgaaaacaactctgaaaatttggtaaacactgtaagaagtggattagaaaggaaggacttctatgtacttctaaactattttgccagttgaatttttgaactacagaataataagttaaaccagtgtgcaaccttccagatgtccaattatatcactgcttccaaagataatgatacaagcaatagacacatagatgaaacaggatttaaagctattgctctctccccagccatattaagtatgtgtctgcattacctatgcaatccaaaacccagcccacggttccatctccaccacaggctaacactctgaagtcaggaacatcacggaaaaagtttaacctgaaaaataagcatgttatggcacatgattaatagtttaaaaataagatgttttcagttttgtatcattaacattttacccgatgaaatacgtttttattttataaaaactgtaaaatatctcagtgataacttacatatcctttaatcctattttataattatatattcaagattctataatttaaaaatattttgtaattacatattctagattccataatgaatatactctttttctttaataaactctaaaattttaaggataaaattagtaaattataataattttcattgatattctcccagatgtgatttgcagttcgcataacccagaatgacatatactacattatttcatttaataaatttcatcaatccaaaattatcttttgagtgaatatataaatgtgacagttatgtcagtaaatatgtctttaacaatgttctactttctccattactgggagaaattgatcagactgcaactggggttctagccaactttccttttgactgagaatctgcaaataggaggcaggcttcaccttgtattttgacctggttgacagtgttttccacccaggaacactctagcctaattgctgggtcagctgccataaatacccactgcttctgctgttactgcatgcagggtgcttaataatgcaacctaccttgggaaaagtcacaaaggcaggtaatgcagccagctatacagtcatagcctattttattgcaataaaaaaattgaaacaggacagaaattttggtatgttatgtgtctcttcacctcccttgtcccaaacataacaactgatagtgatataatatgcaactatccaaggaatttttctacgtacttacgtatacaaattttcgtacataaatctttattacacacatattttcaacacgaataaaactgtgctatacatactgttcattaacttgtgtggttttattttaacttcaaatatgtctaagagaactttgtgtatcagtatataacatatgcatatgtcatgtgttgcattctgtcagattattatttttaagcactgcatcatgttttataataagttcatgtactacaagataaaatgaatgatctctttttatgaatttttaagctatttcctgtgtctcattactacaaaaaagtattgtatttaacattagttgaagaacatttgtgtaaatgtgcgcatgtgttttgaaggctactctagagaaaaatattccattacatcattatatccctctgaatggctcccactgtcaaatatgcaaggattcatttccttgcaaccacaaaacactacatatgaacaactttatgatatgtctttaataataagtgaaagccaatgtctttttatttgttgtaaaatcacacttccctgtttactagtgagttcagcatatttttatacatttcctggagatgcgtaacctgtcctatgaaaagaacactcaaagatgtgcctttctttctattgaattgcctttttattttttatttttattttttttttgagatggagtttcacttttgtcgcccaatatggagtgcaatggtgcaatctcgactcactgcaacctcctcctcctgggttcaagggattctcctgcctcagcctcccaagtaagctgggattacaggtgcctgccaccacgcctggctaatttttgtatttttagtagagacagggtttcaccatgttggccaggctggtctcatactgttgacctcaggtgatccattctccttggcctcccaaagtgctgggattacaggtgtgagccaccttgccgggcgagatgtcttttaataatactttaaaactctttgcatattacagcaatcttcgcatttaaatttgcatcatttaaaaaaattttgtcaaggtaataccaacactgcataaatataataaaatatgtataaaaattactaaaacccatcatctgattataatatccatggatatttagaacaggaaactttcatgcattttctcatttattatattgtggatatttaacctttgtgagacatgttgcaaatattttattcggttctaatactcattgttttgcttatactaatatatatacaatataataaacacatatgtaccagttgcccattccaggaagtagaacatttctaataacttacatatttctctgttttctttccctatagcactgccctttctaatttacaaaggtgagcactactctgaatactgagttaccacgtgtctgacataatcaacatgtgtctttctacttttcccacttacattggtactcagattcattcatgttgtagctgaagcttttcccacgtgtagctgaagttctttctacttctactgctgtgttaaataccacttacatgtcttttaaaatccatgtcaatgggcatttcaactggtttgctttacattcttgcaaaaagtgcattcttgtacaggcatacctcattgtattactctttattgagtttagcagatactgcattttttacaacttgaatgtctgtggcaactctgcttctagcaagtctatcagtgccatgttttccaacagcacatgctcacttggtgtctgtgtcacatttttgtaattatcgcaatatttcaagctttttcattattattatatctgttatggtgatctctgatcagttattatagtaattgctttgaggtgccatgaaccacgcccatgtaagacagagaacataattgtgaatgttgtgtgtgttctgactgctccacccaccagcggttctcctgtctctctttgtgtcctcaggcctcttaattcccttagacacaacagtattgaaattagggaaattaacaaccctacaatgtcctctaagtgttcaagtgaaaggaagagttgcatttctctttcaatcaaaagctagaaattattaagctgagtgagtaaagcatgtcaaaagcacaggcaggccaaaagctagccattttgtgccagtaagccaagctgtaaaagcgaaggcaaagttattgaaggaaattaaaagtgttactccagcgaacacacaaacaacaagaaggcgaaacagccttattgctgatagggagaatgttttagtggtctagacagaagatcaaaggagccacaacattcccttaagctaaagccaagtccagagcaagcccctaactctattcaattgtatgaaggctgagagatgtgaggaagctgaaaaatagtttgatgcaagcagatgttggttcttgaagcttaaggaaagaagctgtataaacagcaagtgctgaggaagaagtggcagcaaattatccagaagatctagctacaattattgataaaggtggtacgctaaacaacaatttttcaatgtagacaacatagccttctaatggaagaagatgccatctagcactttgatagctacaaaggagaagtcaatgcctggcctcaaagcttcaaagaacaggctgactctcctgttaggggctaatgaggctgatgactttaagttgaagccaatgctcatttgccattatgaaaatcctagggcccctaagaattatgccaaacttactctacctgtgcactataaatggtggaacaaagcgtgagggatatcgcatttctttacagcatggtttactgagtattttaagtccacgactgagacatatttctcaaaaaaaaaaaaagattcctttcaaaatattattttcattgacaatgtacctggtcacccaatattctgatggagatgtgcagaaagatgaatgttgttttcatgcctgcaaacacagcatacattctgcagctcgtcgatcaaggagtaattcaactttcaagtcttatttaaaaaatacatttcatatggctataggtgccacagacagtgattcattttggggatctgggcaaagttaattgacaacctctgtaaaggatttaataatctaggtgtcattaagaacattcataattcatggacagaggtcaaaatatcagcattaacaagagtttggaagaagttgatgccaagtctcatggatgactttaaagggttcaagacttcagtggaggaagtcgctgcagatgtcataaaaacagcaaaaagtagaattgtaagtggaggctgcatgtgactgaattgccgcaatctcatcatatttgatgagaattgaatttgaaaggatgaggaattgacttttagagataagcaaaaaaagagggtttcttgaaatggaatctactcctagtaaagatgctgtgaacactgtcgaaatggtaacaaaggatttagattattacataaatttaattgacaaggcagcagcaggatttgagaagactgactcaaattctgagggaagttctactgtgtataagatgctagcaaacagcatcacatgctagagagaaatctttcataaaagtaagtgtccatcaatgggtcaaacttcattgttgtcttattttaagaaactactagagccacctccaccttcagcaaccaccactctgatcatttggttcccattaaaatcaaggctaaactctctaccagaaaaaacattatgactccctggaggctcacatgattgttactaatttttcgcaatgaattatttttaaattaaggtatatacattttttaaaccacaatgctattgcacatttaatagacaacagtataaacataacttttatatgtactgggaaacgaaaaaatttgtgtgattcactttattgtgatattcactttattgtggtggtgtggaaccaaatccacaatgtctccaaggtatgcctgtacgtacttcctagtgcttaagggtagtggccactttagagtaatgcatattaatatgcaactttaccagataacatcaatgtttttcgcaaagaaggtgcaccaatgtacaatggatgtgctctattgaatccattctctttaacacttgtcacgctttttcattttatttcttatttttgtgaaatgcctatttatccttttggtttccattatctattccttttcaccttgttggtttgcaaaaaaattttacacgtctttgattttagtcctttttgaataacttttttttcaaatatcttctacaaatttaaagttttttcttttactttcattaatgtgtattttaatgaataagaacctagttttaatattcaatttcatcatccctttgataagtagtcagtaccttaactagtcttctgtaagacaagcttccttactcagagctcagaattcacatacactctcttaaaatgtcagttttacttttgacatagaaattcttagtttgttgtggtgtgaagtactttcttttcttctctccccactttctcccatctcccctttatcctggcctccggccctccctctcttcctttcttactccctttcatccttccttttggctgtagtggagcactttttttctatttattttttatccatcttttcatttattgaataattcaactttctactatgcaaagtccatgataagtattatttccacatatgggtacatttctatttctattctctattgtgttttactcacgactttgtccatctctgcactagtaccatactctcgcaattactacagctttccagtaagtccatatctcagggcatgaagaatcttaccaattatttcttctttttttcatgtacatttaaactcatcatatttcaccaaaactaaaataatagtaagaaaaaccaatcatgattttgactgaagttgcattaaaactatatattaattttgggagaaataacacacgtataatatgaattaagtttccttattcatgaatgtagtattgctcgatttatttacatattctttaatatccttcaacaaagatataaattttctactaacaggtcttgcatatattttgttagatttattcttcgttgttttgtggtttttgttggtattttaaacatttaaaaattatgtttattaatattaatatttttgttgctggcatatataaacatatttgagtgttatacattgattttataaataatcatattatcactgtttttctattgcttacattttgtttgtggatacatttggatttctatgtatgtaattgtggcatttgctactagcaatggtattattagtaatctctagtctttataattgttatttctttccctgagtctttttccttgacagaattccaacatattgttgaataggagtattcatagtgaatatccatatcttgttcctgaagataagaattacttttggaatctgcccatttaggatatctgttattgagattttatttttctttctttttactttccttctttttgatggagattttttatgaggttaacaagtttctcttctactcctatcataagaatttttactatataaaaatattaagtttttctgcatttttgagatttgacaaggtctctgtcctttaatcggttagtgtgagaataaacatttatatatttctgcattattaatcattcttgaaatcctttcaggcacccaaattgattcttgtgtattaatatttttaagataattgagtttctttgctaatattttgtttagaaattttgcatcaatctttatgaacaaattgacctatttttcttcctcataccacttttgtctactttttaaaattaaaattataccgcctcataaaatatgttgcagagtattccccattttacgattttttgtggaagaatttgtataattattgaagttctttgaaaactggtagcacttgcatataaaacctaaatgtcgggtcgggggaggggggagggatagcactgggagatatacctaatgctagatgacacgttagtgggtgcagcgcaccagcatggcacatgtatacatatgtaactaacctgcacaatgtgcacatgtaccctaaaacttaaagtataataataaaaaaaaaaacattaaagagaaaagtcttacatcattgtttaaattactttagtaactattcttaaaatttatgattttaaattctccttaagtcagcttttttccagctatacttctgtagcaatttgattctccctcctagattttcaaacattggcactgaagcttaagaaaactttgtaaaacacggcagtagctgcaacatttcccaccgagctaactgtttctggtgaaagcctaaccatccagttgactcaccattgttcttctattccatgatgatgtttcatctgttattcattcttgttttctttaaaaattgtcatcattggttcttcagcagcatcctacccccaaacataaaccccatgtgactgtcagaccagcttactctctgtaaattgattgctaatcggaaaatttgacctctctttatctcaatttcttgatccattcaatccatgcagttttccctagaaactcattcattccttactacattcattcattaatatccttgggatttatttagtgattctgaccctcagtttccataactttagaatagaattaacaccacgtggtttgttgggctctttatatacacataaagaaaatgtgtatgtaaatacaccttactattcacatgttattactgatttaattatatttttttctttattaaaagtagtataggtatgttttaggtcagagtgccactcctctatttccccacctcctccgcctgcactgttctggcagaatagtcacaattttctaacaagcagtaaggagagtttttctgcatgcaatctgaaactgtagctagcggacaattgggagacctgcctacagcactggagacacaaggtacagaggaaaacagctgtgatagaagacaagtaaactgaagagtctcagcaagagccaaaatgcagggtcctgcatggcactgacttttcacccaggaaggctgtgatgaggagcagctgtgaggcttccacattacaggtcatccttccaatggggagaagtgagaaaatggggagtgtcaggaaggatttcactctggggaaacttttgtactgcgtattgtactttttacctatcagttccacagtgttccatgtgaagaatgaataagcatgaacattttgcaatgaaatcatgcttgggtcctgaatttatttgcaccattttattaatttttttgaaattaaaaattcaaatgatgtatgaagaaaatgaatgatgatgagtttccaatgttggcctttatagcattgattcacctagagagtttcctatgtatctccaatagctatatttgaaagcaagcctattatttgggtttagcagccctctgtcagacacttctttttttatcatatttgctctataatcaccactataacattccataaagtttcagttatgcaagatgaataaattctaagatccactgcacaacactgttcctatagttaacgacacttttttgtacatttaaaaagtttttaagaatgtagatctaatgttaattgttcttaccacaaccacaacaaaagagcaggtggtgaaattgtgatgcttaatattactaaaaacaaatccagaaaatttcatctaagattcagaggcttactttgtgttaagataaaattgatacagaaaaggcagtaaattttcacttgtacctaattgttattaggtacaaagcacaccaggaaaaccttttttaaaagaaaagaaaattgtagtactgattccagaatcttggaaagtgtcataaatcagaattcttaacatcaatacgtaaatattactttttattccaatcttatattttattattaaaaaatactatcgcttacatacaatgtggctgtatgggttagaaatagattaagtatataaaataaataaatatatggctctaagtagtatatatattataaatcataaaataatatttttgatacttagaggaaatcagtgtgagagtcataaatattttcagcatatctatacatggtgaatgctcgctttaattatacatatttacatctctttgtattaaagaaacacaaggctgaaggatccaaaatgactttaccatatgtcatcaattctctttttcctcgttcttgtttagaaaaaataatttcaagagctttccttacgaaaggtctgcattttgatttaagcatttagagacagaaagaagcatacttatctctgattattctattcaattcatatttatacttgcatgtacacagttacatactatattattcttaaagttacaagattagatggattcaaaattgccttagtaaaatctggctgaattttctgatttgtgatgttaccgttgtttttgaaacaatatttatggtctagaaaaccaatttttaataactttcagcttatttattaatacccaaactgtatctgtacataccttggtatcattgatattattattattgctggtgtaatatcttttaaaaatccatgcatgaattatttatgctccctaaagtttcactctattatatatattacaaaatgggggaaaggttatttcatgtttttctctgtgggtttcgatgttttatcaatttaatgtgactctctcaacattttaatttaaagtaaaattaattataataatatcctccaatctaatatcttatgtactttagttcaacaatacattataaaatttagttaaactaggaaatgcacctgtttcaacaaattcgtttagagttttgagatattgtgtggaagctgaatttacactgttttgggaagacattccatgtggctaagtgggatagttataaaaaattaatttgaattaatctttataaacccagtgtaaataattatgttaccataataaccagaaataagttttagagtatttgaaaaatatacatattccagtgggccattaataactgaaacatttatttcattatttctggaaatctcaaacaaatcttttatgcttatgtgtgttaaaagtgaaggagagagggacagagaaagggaaaaacacagactgaaatgacaaaagagagcatgagacacagaaaatgagagaatatttattcctggggaacctataatgttatctcattaaataactttaatattccttctaatataaagtgagttagaaatgaaaggtcagtaaatgacaggttctatgatgtagcctaaatatttttcctttcttcactaatgtacatgtttctttaaaaattaatattggcagaaacatcaaatttttaatgtcatttctgagtgaatagaaacactaatatttagttgaaatatccttgccatcatatagaaaatatttataattttattagtataagtaaaacacttttgtaaatatatttgttaaaatataaattttttctattgcatggaaaattataacccttgaaggatatttttaaagtacataaattaatattcaaaaaccaagtaaccgatgttaaacaaaaattatgagtggtcattattttagactgagcttctgcactaggccccaacagaccagaacaaaccagaatggagtcacttgtgctaagtgccatgtaatcaaattgaactttaaaatggtccagttaaaaaaagaaaaaaacaacacaggagatttgcagcatccaatcagaaggggcccagttcaccagagctagcatgataaggaagtcctttcggttttgaccctgtaagaaaagtaactttgaaatgaccaatctgcctttcatgccttatttctgctttcttcagccctcttctgcttataaagccaaactcctgtgctcagttcattggaacactcatactattctatagaattaggtgttacccaattctagaattgcaaatataagccaatgagatctttaaactaactttgttgtaattttgttttttaacactgaagaacacaaaacaccttttaaaacgccattttctctcatctgtaagtgtgttttttacattagaaagggagggatttaattgaacttagtattttcatactgtatttactgctacaaatacgcagtaaaatttatggtcatgctacatgaaagtccatctcttaaggtattaatgaatatgcataagttatgtgtgtactgatatgcatatatatatgtttggaaatgcaggttaaaatatttcttgtaagttacatgactaaacatagagaattgacagacaattctgatgtagtaagttgaaaatgaagggaaaaatacgataaagagtgtcaattaaaacagaagttacacagtcttcctgatatttgaaagaagttaaaatggaataattcattcttattacttctaattggaaagcacatatattttatggtccaaattcatcatctataaaattaacccctaaaatgtagcagcacaagtgattaggttgctgaagactgtttgacaaatttactgaaatccattctgtcgtgtgaatgattttaatattaataattagaatgaggttttattctgtacacatcagatcattccatggagttagcttagagtgtgaagtaagaatgtattttgaaaggaaataaatctagacttctatagggaaaaaagactttgcttagggtcaaatacaaaagaatagctctaaatactttataaatgaaatggcacctgtatctatccacttatttaatttaaatgtagtaactgcaactatgtactaggaactgagatagattccagagattcaaaacaaggtagaattcttgcctttgagtatctcactggcttaactgagaaggcagacaagaaaacacacagttcaggtcactataagatgctctttgagggcagttaatgtggactaggtagggatgaggggtggcttaataaacttggagacatatgagttgaatctcgaagcttaggtaaagttaattagctgatgaattgggggacagaagtgaggagaaattgagtgaagggttgttatgtaagaaggagggtaaatatagatcctaggagagtggttagatgacaaatcttgaaagcctgaagtgacatactgtcagtgggaatgagaaagcggttctttagtgaatggtctttttattcatcaagttagagaataaaaacagtgtgtaaattcgggaaaaagggagaaaactagtttagtaatagacatgtagaatttgagatactcatggaacttgtgttcatggactattgaacataataagttaatttcctccttatgatctctctttgataaataaggagcaggagagtgaatcctgattatgtagggcctgatgtttataaaaattgaggcccccctttaagaaaaaatatgcaaaataaatgtgtacaaacttttataaaagtgatgtatatatataaatatgtataaataaatacttatctataataaaaaatcacattagattgtaaatttaagatagcttacaaacattacatcataggatttcaaataacatagttttataaattagtaaactgcttaatgcttcgtttttacatttttatatggtaatttaaaataatatttgtactgaggttaaaagataattttcttttcctctagaatgatttattaagatatgtttaaattgatgatttattaggaatgttccacttagcttcacaagtcatcattgataaagtaaatttttagtattattgttaaatacgtgaaaatcaatattgggtttttggtcatagccaagctgtaagacttgcaggcatttcaattttttgttcaatgactaaccttaagtactgtttgaattcatgatatacattaaccattgttacgttaataacatgacatattgtgagttttaggtatcttcattgatggcgatatttcatagagatttataaaacatgtactttacacataaacatgcctgcttgttgtagagctgatataggctgtgctctacaagcacaggaataatgatacatttaatatcatgtaactttcatcaataataaaaatttaaaattgtttatactgcattgttaactgtattcctggaagaataacgcttctgttttgatgacacattaaagagaactgaatgggatgattagaagaattttccaaggataagctttgaactttgtacatttcaaacctcatttctcccctactatacacatattctgttaccaggcaggctctggaccatttttatcaagacatgtcttctggctctttaaatttatgtcagaaaaccagtgtaaagtcacactgagcaatggggatatgcctggaagtcatttttacaccaggagaactagcaataacaaccatacacaaaaatatccatgaaccacatattataagtctcagggttcaatcatgtaattggacctcatcctcttttagtcagatcctaaaatgctcatgctcattccaatgctactagtcactaggtaaagtgtgatgaaaaaggagttggaatggagacaaaagtcttttttgttttttactgttttatttttccatatagatgcccaatttttctggttaataccaatacatatacagggcatgggggagggctcttaattatcttccattgatatatttgcctctctatgcattactactgagctggcttaactaacattgttcataaaaattcttgtagttaaaataccctctttttaaaatatcaaaaactcaaatgagaaaggcaatacaaccacattgctaagatccttcctatagtcttgaaaggagtccttgcaagtgagagacactgaagttgaagattcattgccttcaagagcatctgcttctgggcacacatcttactatagcataatactggtcagagaccataatttaaaatatgacagctactcgggaggctgaggcaggagaatggcgtgaacccaggaggcggagcttgcagtgagccgagatcctgccactgcattccagcctgggcgacagagcaagactccgtctcaaaaaaaaccatgaataatttaattacacagaattctaactataggcataaaggtaactaaatgaaaaatacatgactcatcaagaagagataagtaaaagtaaataatgtaattggagaataaaacattatgaattcaacaaacatctgccattttcaggaaatgatatgtacataattgaagattagtatcttagacaccaagatatttatgattttaatagttgtaaatataatttgtatcaattttatcaaatgtattatattccaaatccaattatctgcttttcggagtgtgtttattaggctaaacttgtcttgattacgaagaacactgttacccaataatataattcaagttgtagatttctatatgctgataacctctatattaaattaccttaaattttcatgctccttgagttgcagattttaaatagaagaggagggtatgtataatcaggaaaagactggctgaaggactgttgtccagagagatttttacagggttttattacttgagtcacctaagacttgagtcttattattattattattttggtccagaaggttcctgggtgactactgaatcagtaggagaataactgaataatttacatgtgtgtgtgtgtgcatgcatgtgtacaagcaatataattatggcttttattttaattattagaatattaaaatttcttgggatgtgattataatttatgtgagcaatcaatttaaagcacaatcttttttatcaatcaattcattactgtattagaaatcacgtttttgccatgatggcatgcttcaccagaatctacattcaaattattcccacagaaggaaattattgtatcagtagtgctaaacgtttatactgattttatgatagcattatcactaatatctaatgtctcaccttcatccaaatgaacttccaaaaaactttatttagagtgcatgaattgaatgaattcaaatcatctttgcaacaaacagatgtttcatttaaaacattctgatcactctgatataaaaatggcattacttgatcttttggaaaagttattctgctaatggagtcaagatattaacagctataacttcattaataatacacataaagaaacttggaattgaaaattaacactaattttgaaaagtcatttgatctaaacgaaaagtcatgcttcaaagagtgatatgcaaagggactttctgcatactaaatgattgctttggggcagagaattaactattaattttaaagcagatgctcatgtttcttcagcatagttgtgtttactgatttctgcatagtcaatgatatcactggagctctcattgcagatggtaaatgttcataaatatttcacacagattatgtattcatcaactctttaagaaacagaaattcagaactattttttgttttgaaattcagattatttttatttaaaagacattttatttttaagctatcttttgctgaaaagtgttattgcaaaataaaaatctattataaagtaaatatttataaactatatatttaatgaaaaataaaacattgaggaagtatattcaagccattcactatacattcttggtaaaactgctcatgctctttttctcacatacatttcatgaacatctaacctatgatttgtcaatatctccacaggcatttctgattggtatatttgtgaccctttgcaactctcagggagctgtgaggtccaggccacagcataatgggctggcataaaagggataccaattcttcaaaagttgtcacttgtttttgtgtttaaagaacattggaaaatagtttatttttggtcacgttttaggtataatgattactattaaagtcagatctctcttccttggacgtgtgtcttacacattacaagaggataacacagcaaaagctggatttagaaattggagggctgccaaacacatcatcatcattcttcattgcaatgcacttattaatagcaatacttaaaatacaatacagtcctgggcaaatgctaaattgggccagatgctaggacaccagaaacaacctgaagaatcttaggtaaacctaattattatggtcacaataatcctaaaaccctctgtgaactagcccttagtagctttctgacatccgactgcccttcactctgttctagtctccctgggcttcttgctaatgtttcccaaacttacacaatattttccaatcattatgcttttatgcttgctgctctctctgccttaaaagctcttgtacaagatgacaatgagctacctcctcatcttcacatctatactcagccagttcttctccacctcatttaaaagaacaaccacgaaaccctcaccaacaatgcacactccttgtttacattccctgctaatatatgtatatttcacctgtttattagtttaatatatgttttccatcactaaaatataaggctgtgagggcaagagttattatccgttttgttcagagtggattggcagtgatgagattgttcctggcatctggtagccattgaataaatgttttgaaccaattcatctgctatgggttttcttatttttacttattggtaagctatcatcagttaactgcctggggctggaggtgaatttgagccagtaattttactatgtacacttacataacagtaaatgggaggatatttaagtaaaatatgttatttattaaaaacttaactcctatagaaaaaaaatcagaaacagattactttagttcatttgtgctgctatatgaaaataactgaaactggataatttataaatgacaggtatttatttctcacatttctggaggctgggaagtccaaggtcaagacatcaacagatttgttgtctggtaaggcttattatctgcttcaaggatggcacgttcttgatgcatccactcatggcagagggatgaatgctgtatcttcacatggcagtagaaggggaaaggcgagagctagttcccttgagccattttataagggcattgatccaactcatgagggtagagccctcataacctaatcatttgctcattgctccacctcttaatatgattgcattggtgattaaggttcaatataaattttggagagacacaagtattcaaaccatagcattctgcctctgctctcccaaaatttatgttcttctgataagtaaaatacatccattctatcccaggagccccaaaagttttaacaatttccagcatcaactaaaaagtctaaagtccagagtctcctctaaccgtcatctaaataatacagagttaccactccaggtacaatttattttgaggaaaattccccaccagctgtgggcctgtgaaatcaagcaagttaggtccttccaaagtacaatggtgtacgatagaatggacaataccattgaaaagggataaataggaaagaagaaaggagtaacaagtcccaagtaagtccaacacccaacaaggcaaacaacattaactcttgaagctgggaataacaaaaaccaaaaaaccctctttgacgatgtgtcctgccttctgaacacactgtgcagagtttaagcccctaaggctccgaaacccccattccttccatggctgtgctgtgtgcagcccacactgcatttctcacttgttagagttgaatgccaacagctctctcaggctggctttactagcctggagtctcagaggtggcccagcccccatagctccactaggcattgtcctagtggaggctctctgcaggggcctgaaccatgtagcagttctctgtctggggtctggggatctcaaggacctctccatcctttgaaatctaggcagaggtaggcatgccttcacagcttttgcactctgtgcctgcagagttagcaccagctggatgctgcaaacctttgccacctctgtctcctgaagggtggctctggttgcactgaggctcactggagccacagatggagtggcccaggagtgctgcactagaatgcattgagcagaaacttgaggcagctctgggaagtgagccctgagatcccacaggtgctctgaatccctctttgaagtctttctgtcctcaaggccctgacactgtgggcctgtgatgggagtggcagccttgaagatctctgaaacgttttcagggccactcttccattgtcttgatgaatagcattctagattccttctagacatactaatctacccaaactttcattggtaacacccttggtgttttatcataaacacatttctctttctttaccaattggccagtctgagaatttgtcaaatccttaatttttgcttcccttttgatgacaaattctgtcactaattcatttctctcttattacatcttactataagcagtcaagggaagccatgccacaccctcaacactttgcttagagatttcttttaccaagtatcactccatggtatttcatcactctaaaattcaacctcccacaaaatagtaggacatggatacaattcgacaaagttctttgccacttcataacaaggattgcctttcctctggttgcaaataacttgttccccattttcgtatgaaacctcattacaatggcctttcttatccatatttctagcaacattttgttcgcaaccatgtagataatctctaagactgaacctctctctatggtcttctttctttcttcttctatcccccacctctcctcctcctcctctacctcctcttcctcctcctctttctcctcctcctcatcctccatattgcagcctctccccagtccacatagcaccttctacgtttttaggaatttgttacattagcacctcactccttagtaccaattctgtcttagtccattctagcagctataacaaactactttagtctgtaaagtctaaaagtctataaagggtaatttataaacaacagaaatgttttgatatcacaggggtacagcagaagagcaatttagcccaggatggatcataccttgagtctcatccatatctgatttagaagatatttagatgagactctgggttttagatttttgagttggtattaaaacaaattaagactttgagactattgggatggaatgaatgtaatgtatctgtatgtaagaagaacacgaattttgggggacccaatccagaatgctatggtttgaactttcatgtgtctccaaaattaatgcttaaaattagtgcccaaagcaatagtattgggaggtggggtactgaggatgtgattaggtcatgaggactctacgcttacgaatgggattagtgaatttgtaaaggggcttgaggaaaccagccagctgtttttctgctcttctgccatgtggagactcagcattcattctctccagaggatacagcaagaagacaccaccttggaaacaaaaagtgagccatcagcagataccaaatctcctggcccctggaccttggacttctcagcttctagaactgtgagaaataaatttatgttgtttgtaattagccagtctaagggattttgttatagcagccagaacagaataaaacacaagttaaagcacacacacaaatacgaaacggtcatttcaaatggccaattcagaacatgtttgtttctttagagtgtttcagcaattttgataggcaataatctttaaacagtgacacacagatctctagtctaattgctatttggcctttgttggtgagatagataataaaagctagacttttcaacatctttaaaatcatagtgcatttgtggatgcatgtaaaaggtgactaaaggcctacaatgactcaaagggggaaatttgtgtgaaaggcaagcaattatgtgaccttattcattgtggtaacatatttttgttacttttattaatccatagatctttaattttagaagcatgaatcaattttcatactccatcactccagtgaccaaggcagaatcagaattatgcttacacatttaattgggggagagcttgccgaatcatctgcattttattttatgattaatcatgagaaggatagagttgagtgcttcacttttatattagtaaagaaaattttttatttttgaaatttgcaacagagctcaattaaattttgatgaacatttccttagccttttgaggattctgttcatttctgtgtcataatttcataacaagaggcatatgtaaaaggtcataagctctgattttccttaaataaaatatggtagaaatttggttatataaaatgatattttaaattaagaagataatgaaatctgtgaaatctgttatgcattttctaaattatacatttattttaataggagaatatattccaaagtttcactatgaaatatgcatatttgaaatatgtaaatctgtaggttgactgttgcattatatttttaaaattatgtgtcgtttgcatttagttcaggtagatggaagcaaagatttctaagagcagctttctcacacacaattaattattcttaattatcctgatcaatctgaaaaataatttacatattttaaagttatcttgtattttatttcaattcattaagtgcttcctatttctcacttaaaattttagaaataatgtgagaataaaccatctgtattttcatgaagattagattcagaaggggaaaagtaatgtcacaagtatacaaaaaacttgatatgaacttttcataagtcacattaacatgtgaagttggtgtacagctagagctatacatacttattttaatgtagtgaaggaaaacatattgttatataaagcccaagagtaatttatattttatatttcatctcttctaactaacctatacctccaaataatttattcaattatatcacaacatgttccattaggaaagaaacaacttatttgaaagagactattgtttcagacaccttgaaacagaataatcaggatcagggagagatgatttatataaagagatagaatggaaacacataatacacacccatttctgttttaaaaacaattaaagataaaaaatgaaatgcccagtgagttttagtatttgccagataatttagattaggaatagttttagttcaagaaagttatttcctcttataaacatagtttttgaaaaaaaataaagttgggataaaagaagagttgtataccaaaagaatacatcaatctggtgtggtaaagaggaaaatatttttaaaaaagaatttggaagaatgcataaccacaggtttaaagtagcagaaaaaatgcatactatactttcaagagtatgcattcaaaaacctattgttagcattggaaaagtaataaactagaaatggtgataaaactaaaatgtataaatcaccaagggtatcagagtaatagggagaccttatgaaacagagcaacttctaacgccatacattaaaagggaatcactgcaataggacactcttagcatgatcaggggcaatacagctagaaaacagggctgggaggattcacaagtgagcagatcagtcattgagttcagagaaagggcaacatcatagcctggccagagtccccgttctgagcaactacctgtggcatttgcctttaggataaacaaagactagctctctaacagaagtctgagtctgacactagggatgcagtgtgggcatcagtatcagaggcaaacaggacattctcatgttgatcaagatgaagctaaaagttcaacacaattatatttaatcattttttaaaacaaacttttgacattgaatattttcagccaggcaattctactcatagccactgataccataaaaatatttgaacacactttcaagaatatgcagataaattgatagatattgacgtagcatatttggtaataattgtaaaacacaggcaatataaatattcatcagtaatgggatggctcacatgattatggaatatcatgcagcagttagaaaaatgaaactgatcaatgtctactgaaacggaacaatgtgtatcacctgctttagagtgcagaaagcaagttgcaagataatataaaatctatattctgttacgtaaaaaactatctacctatatttcatatatatatttcatatatatatactatatatatatacacctatatatgtgtgtgtgtgtgtgtgtgtatgaatacgttatagatagaggggaatatgctcatttatatgtgtgtattagattgggaagctacagcaaacaaccacaataataatttctgaggagtagtagtgctcaaagtgggacctttaaatttttttctaaataatattcattgtagtgtagactttttacagttacatacattactttcattttttaaacatgttaagatagagcagaggataacaggatgcctagaactgaaagagtagaaggaaacatgtagtacatatttaaagtgtagtaggaaaaaagtgagatgagagaacagggctaaaatcaaatttattccaatatatttacatagtgctacaaaacagtcatgtttttattaattattaattcatatttgtacaaataatacggataataaaccacattcactgaggacatgctatgcagtaagtacattgttatttgcttcataggcattatcccatttaacttcacaactatcctataaggcaggcagaaatcctcattttacagataagataatgaagccacacagaggtgaaactgtaaggcttgtaattagcagagccaattgacctcttgtttaactatgaaatacaggaaaatcctggattaacttggtttgattcaacttacaggggtcttagaatggcaacagttttgaatgcacaatatcctaattcaaagaagagctacttttttgaagtccagagaatattaaaggacaagaaaaagagccatcctgactgagcttgagtttacaatactttacttttgcttggctttatctacttggggacttcctgcatgtagctagctcacttagccaacagtctgatcatgatcctctagattctggattgtgaagcttgacaaagacattgttctgaactaaattcctgtgatgagcctgtcttccacaggaaggaggttctgcagatcactgctcagcattgggaaactgatcccagacagcaggcagcaaggcagtagaagaaagagctgaatataatgctgaaagactatgctaattaattatactttatgaatgtattttttgggtaagacactatggtacaaattttattctgagtttttaaaagagtactatttaaatacttggtttctggttcctgagaatgagaagtaagactaattttaaatcaactgccttttttttaaaaaaaaaaaatgaagcatgcataaagcttatagagcttctgtccacttcatgtggtctaatgtttaccctcatgttgacagaaagaaaagaggtcaatgaaataaaatgacattaattatttaactaagccaaattaatggtgatttgtttaggtgcatatcagtaacttcaaaagtatacagtttatgttaaaaatttattttactagatcttacctgttaacaatgaagtataagagagtgatattgattagatttggtaagtagtaaatgaaatcgtatgatttttttcattaacccatttatgctggaggttgcaatttttaaaatttaacttgaatttaaaaataagaccttggcaatgaccttaagctgtagaatataaataactcctacatgcttagtgttccaataatggaacactaggcataaatggactaactagctttctctttacttttagcagatattttaaatataagaagtacaataaaagagaatcgttcttcaaatacatggtttggcagtgttcaaactggcattcagctagtttgtcgtgtgtgtgtgtgtgtgtgtgtgtgagattaatatcatcattagtacaataaggagcattacttcacaatatttagaaagaagaaaaatctgctagaaatggactattttggaaaaccagtatttgcactcatttctcttacgtagttgatatttcatttttatgtactaatatgctgctgtgttcaaataacattatttctacatatgtcaggcagcttatttaattaattaacattaactgagttaatggtaataatattatccttggacttaccctggcattggtccatttccagaaagactgtaaacctgacgaggatttaatagatactggaattttctgtaaattctataaaggtgaaaatgtggggaaaaaatttaataatattcaatacttttaaaataagtaatgtctctcagtgttataaaatatatatagttgcaattaattatataatttaataaaaaatttctatcaatttaataaattttgaatcaatatcagaagtccaacagctcaataggaattaatggttttttaaaaggcttagtagccactattaaggcaatatagttcataagttagaaatattgcttggatccttaatatgcacatacatttaggatattctctaacccgcttttgaacattatttagctaactagatttcaaataaatgtatttttttaatatttcagtataaaattgcctaaatatcttctctcagtaaatccttgtgaataatttgtcctctatagatctctgatagatctgaaaattatctatcccctatatgaaacgggactgtacattgtatatgtgtacatgtaagcaaagaatgtagcctcatctggcctaatcatttcacataaacaagatcttgaccagtcatctcacaaaattgctaaactgtcttagcagcatatgacaaataattctttttttctgaaagaaaacaatctttataaataaatgcaatagaaatgtttctatgcatgcacatatctcacactgttttaattcttagacaaatactaaaagtaaagagataaatagtacatcaaaaagttaatttaccacaatcagttaggcattattcctgggataaaaagttggttcaacatacacaaatcaataaatgtgattcaccacataaatagaattaaaagccaaatccatataattatctcaatagatgcagaaaaagcatttaataaaatacaaaatcctgtcatgaaaaaaaatcttcaacagactagacatcaaaggaacataactcaaaataataaaagccatctatgacaaacccacagccaacagcacactgaatgagcaaaagctggaagaattccccttcaaaactggaacaaaacatgcccactctcaccactcctattcaacatagttctggaagttctaatcagagcaattagacaagagaaagaaataaaaggtatccaaacaagaaaataaatcaagctctctctcttcattgataatgattctatactcagaaaactgtcaaaattccaccaaaaggctgttagaactgaagaattttagcaaggtttcaggacacaaaataaatgtataaaaatcaatagcagttcaataacatccagccagagtcaagtcaagaatacaatatcatttacaagagtcacacacaaaaaatgaaatacctcggaatacaactaaggaaggaggtgaaagtgctctacaaggagaaccacaaagcactgctgaaagaaatcagaggtgacacaaacaaatgaaaaaaaatccatgctcatggaagaatcactatcgttaaatggctattctgcccaaagcaatttatagatttaacactatttctatgaaactaccaatgtcgttcttcaaagacttagaagaaaactcttctaaaattcatgtttaaccaaaaaacagcctggatagccaaagcaagcctaagctaaaaagaacaaagatggaagaatcacaccataaggctacagtaacaaaaactgcatggtactggtataaaaccagacactcaggccaatggaacagagtagaaaactcagaaataaagctgcaaaccttcatctgatcttcaacaaggccaacaaatacaaaacaatagcgaaaggacttcctattcaatacatgttactggaatagctggctagccatatgcagaaaaatgaaactggactcttttctttcaccacatacaaaaattaactcaacatggattaaaaatttaaatgtaagatcccaagctatatttctaaaagaaaacctaggaaataccccacgtgacaatggctttggcaacacattttttattaagtcctcaaattgcaacaaaaacagaaattgacaattaagctacagagcttctgcacagcaaaagaaaccatcaacagagtaaagtgacaatctgcagaatgggagaaaatatttgcaaactattcatccaacaaaggtgtaatatccagaatctataagaacttaaatcaatgggaaaaaaacaacaacaaataaccccattaaacatgagcaaaatacatgaacagacacttcttgaaagtcatacaagcaggaaacaaacatatgaaaacatgcttatcatcactaataatcatggaaatgcaaattaaaaccacaataaaacaccatctcacgccaatcagaatggctattattaaaaagtcaaaaaccagtggatgctggcaaggctgcaaagaaaaggaaatgcctctatgctgttgttgtgaatgtaaattagttcagccattgtagaaaatggcttgaatatttttttaagaacttcaaacagatctaccattcaacccagcaatcccattagtgggtgtaaactcgaaggaaaacataccatataccaaaaagatacatgcacttttatttgcatccctgctgtattcacaagagcaaagacatggaatcaacctaggtatccatcaatgctgggctggataaagaaaatgcggtacatatatagcatggaatactacacagccattacaaaagaatgaaatcatgtcctttgcagcaatatggatggagatggaggccatttccctaagagaattaacacagaaacagaaaaccaaatactgcatgtactgcacgaaatgttaagcagcagctaaacattgagaacacacacacttaaacatgggaacagtagacatgggggactaccagagtggggaaggaagaagtggaggaagatatgaaaaaaactacctgttgggtactacgcttgctacctgagcataatatactcatgtaacaaacctgcacatgtacctcctgtatctaaagtaaaagttgaaattaaaaagatttttttaaagttaagggatatatttaaacctaaattggttttatatacatgtgaaaatatgattattttataaacaaattcttatgatatttactgataaaactctccaaattcagtatgtaatatctgctcatatcacctagagttgttctcaataccctcttttccctggcacctgaacctactagtggacaactctgtgccttcctaaaagaaaacctaggaaataccctatctgacgttgtccttggcaacaaacttaaaaaaaatgcctatcaaacctggctattctatcccactgccttacttaaggtcttcaagttctttcaccagctttataaatttcttggcaatccagccttcctctatactgttgtctaagtacagccatgccttatccatgatgcaaagtttatgccagtgtccagttattcacaatataaaattaagacatcttcacaattcagccacagtttctctctcatctttcccctctttttccttacattgtcatcccggtaaattcctcttggttgacaccctgccatttcacaagtctgcctttctccttctttcattgggcaaacatctaccatataataacctataaagaagctccttcttctctaaagacttcttggtcttcagagatagttatctccttctctgaactttgatagcacttttatcttaaacatttctacttcaacctgtaatatatggtattgcaacagatctatttatgtccctgcctctctgcacgactgtgtattatgcctcttattcccagtcactagtagagtttggattcaactaggcattgctgtctgaacacatatgtgaacattttcagacttattgattgatatggaaaagtttatgtggatttatgattctgtgaccttttgcaacttatctaacatatcaaagtcaaaaaagccaaaaaatttggaaaggaaaacactgaacgggatcaccttgtgaaaggtgcctcttatgcaggcagaaaaattatgtttgcattgaaaacagatcacctttaaaacatatttacatttcatttgacttcgcgtggtcccagtcaatgaataaagaacaaaacacacgtggatgtgtatatagaagagctcgaagttgaagcccccagtaaatttaatttacttaacattttagtgtaactatatatatatatatgtatatttttaatttagggaaaattatttatatgtactggtagaaagggaaggcaaatattcaactaagggtcattctacatgattcatattatcttaattggagaaaaattattttcctttgaaaatactattttttttctcttcaaacttcaatattctgtaatttccaatgtggatttaagtctcatctaatcctttgtggaaagttttctttttttgttaaactatcaataacatatacagctaactgactgtaaatagtaaagaagaaagtaatttcagcattattatttaatgattattttatgagtaaaactattccctttaataaagcattaggaatatttttaattattaaaacattatttaaaataatttctatcatgtttagaggagtaaaacataactatatactgatgaaaagaaaaaatcttatactcattttattttattttattttattttattttatttatttgagacagagtctcacacggtcacctgggctggagtgcagtggcacgatcttggcttactgcaacctcccaggttcaagtgattctccttgcctcagcctcccaagtagctgggattacaggtgcccacgaccatgcctcgctaattttttcgtattttagtagagacggggtttcactatgttggccaggctggtctcaaattcctgacctcatggtctgcccacctcagcctcccaaagtgctaggataataatcttacactctttaaagcaaaaatgttttgttgattcaataatgaaaagcattcttcatttcatggaaagaaagctggaaagttaaatggtagaaaaaaattactttattcatggaaacatttcaactttgctatttggtgagccacaaaggaaatttgttatactgttatcatgtttgttatgagtgctttcatctgcttgcttatttttggttgagattaggagagttatctaaaaagcattaaggcaggtataaatgcatttttgtttatgactgtcatctttaggaagacataagatttactcttcaatgtagtgattttcatatttgtattaaataatatgatttaatcattcattcattacaaaataaaatgttatcagccagaatgctgaaatacctgataatgcagctcattattattcagattaaatatattgtacttctccaggaaatatggcatcatgttctccaaaatgcacatgcagaaaatcattataatatattttgcctagatgttgggtataaattcggttcctcagtactgaattatgatttatgtggattcatcttgttaaccatttagagaaccaattttcattcaacagtatttatgaagccagactctttgttaggggataggggtgataggtggggtagagagaattcaaacacctgagctataatagtaaaaatagttacaaaaggccattgtattaaaatttcaatcctaaaaacaagatcatataaacatattaaatgctagcatcatttattttgcattaaaattagcagagaggaataattgtttttaagcatttttacatcatagttttgtctatttttttacatatacatgacatagacactaaaatcaatcaaaaaacataccgttctccttgttttccaccacttttggggttcacaaaaactaaaagtgggtgagtaccaggcacaggagtgacctataagaaaagttatatacatggaaaaattattaggcccattatatatgaagaagactccttgttatttctaaattataaaataccaatacgcaatttcaataatattactttccacaatgtgtgtgtgtgcatgtgtgtgtgagtgtgtgcgtgtgtgtgcgtgtgtatgtgtgtgtggtgtgttcaacaggaaaacctcctccacaaagaaaggcatgcctatctagatagagggccgaggggaaggcagtcaggaagagggaataacatttgtaattcctgtaagataaaaaaaaaaattacgattttcagacagtaagtgaacaagccagaatacagcagaatttgaggaaaaagggatgagaagcaaagaaagagatcaacttatagagaggcctccttttacgcaggagtcctaattgagagtttcgaggcatgtgtggaatccatcttcccaaccacctgtgaactggaaagaaactcaataagatcctttgaggtcccttttggcctaagagtccttatctacacaatttgttcagtgctttcttttcctccttgctgaataggttgctagttaatcaagtatatttgctaagtagagtccattaactattgatctctctttcaggtaacacgaattgactcgactatacgtcatgtgctactgctttcatcacaactcagctctcagttgaacaagaaagacaaagtttctgtcctaatggagcttatattatagtggagaaatatacaataaacaaatacatatttagcaatgaaacatgccacgatgggaaataaagcaggtaaggtgatagcacgtatttttgtgggtagagttgttttacgtagtgtgggaaaggacaagtgttgtctcttacctgattccaatgttaaataacagactttttaaaataaaagtattcctattcaatgtaaccctatgtaactcccatctaaatacagtttgatgaaaaaaatttaataacaaaagtattcagctaattgtgtcctctaaatactaagttgaacagttttggatcaatctgcttttttgaaagtacattcaaattatctttactgcagtgttatttctcccctagaaagtagtcttaaatgtttaatgagacaattaaaaacactcattttaccatatcatgcccttccttcctgtttaacaatataagttaaaatattctactaacatattttcctccacttctttagtaaaatggcatttttctaatgagaataggcaatggggaaatgttaaaatctccacattaccgaagtgggaagattgactgagatactcgtaatttttctattcatatccaactagctctcattataatttactgtgtctgtttctattttactttccattgcaaagaggacaaagtttctttcttcctaatttgtctccaattcagctgggagaaggatgagcaggaaaaacttatgcactaacttcccaggtctcccctgaaccaaatgtgtgcaatcaattaatgtacataaagtgtctattatctttaagccatggtggctgcggattgcaatgggtaccccttcctcccattaaaaactaaaatcaaacaaacaactatatctaaaaacctgtgttcgattttctttatttctcatcctattacaaattgaaactcctaacgttttcataagcaaatagcaataataaatagatgtagattttagttgactttttagtcaatttgaactgtttctactggtttttaagtagaaatgggaatctcaaagtaaacagatttttaagcatgagcaaagtattaactctgaacccaaatactcattaggatgagttttccttttctccctaaagtcaacattcattttataactatatgagattatacaaaaattcatgctgagtccaatatatggaattattttcaaactatgttttgaaatgtctctcagagatatttaattgtgagaatatttatagacatcactataaattgtcaagtaaaggggaattaaaattgtattttaagttatatactgttatgaacaaataaatatcccactggaatagattatagtctgtaaggaatttcaaaataaaatacaaaatcttgatgtaatttttaggggtagttaaatggagaaacagattaaatgtattagaaaaatcagagaatttaaagaatttagagcaatgatgatattccacaagtggcaaaagttgaatatccaatatggatatacaggaataatatcaatcaattagcaaccattattttacataatacttctctcattattgagtatgagttcattttcagacagtcctaacatataaagtatgagataagtaaaattgtggatattatcacatgtagtctttcaattagttaatttgatctgtttgattccagattctggttttcagagaggtccatcaaataagaactatctttgcattgtattgcaatgcaaaacatgtctactgacaaaatgaatataaatagttttcttagtttctgaaactcagtatatctgattttggtgaataaagttttatggaaatatcttacattaatattttttaaattttacagtaatatttttatttttttgaaaaactctcaaatttacagaaaagttgcaatgactctcaattaactttttccctcaaccacttgagagtaagttgccaaaattctactccatcactaccactcccatttacattagtatttcctacatataaaaacattctctcgtatatacatatatatacatatatataatatacatatatacatatatatatatacacacaatacaaccatcaataacagaaaactaatatgattttggactagttttgtggaaaaaaactattattgggacaactgatgaaacctaaatgggatatgaggtaccaatgtagttaggtaccaacgttatattcaagcttactaattctcttttggattgtatccaatctgtctatgaatttagaatttttactttcacaaaacaattgtgaaataatatgtaaaattcaattattctgaaaatacatttgctgcaatcctaaaatattgtgtcctttttgttatagattttggtggagtaggaggtgaaagataaaaacacaactatgtcaaaaattctgtcagctgaaaactattcattctttgaagtacatatatttatacagcatttgagatcatctgaagtagaacagcatatagaacagatgacttcctagttgatttgtttaaaggatgaaagaaccctcaacctgctctcaatctcccatgactcttccattgtgcttgaggctctctctacagagccctgtgtcttttcaaaacagttaaacaatacttgagatacagtaatacggtttcacacacacaaaaatactgatgaagagagaaagtgtctaggaaagattttatagcatctgtggtagttgaaatcttgaagaatggttataaatttgatgtgcagggtattccaggagactgttcacactggattctccaccatactgaatagaattcatcatgtaaaatcttacttaatcacataaaggggcagttaaaaacagtacatttaaagagcatgattttagagttagactggttttggatcccagttcaatcacttctctctatatacacactctgtcctttaatgatctcatcttatctgatggctgccatcaatgcctttcactcccaaattcatgtctgccttttcttctaatttctaggttcacatattggtctacctacttgatatttttatttggatatctaacagcagcagaaatttccctctaaacattcatacagatgctcccctatctcagtcaatggcaatttcatcatttcagttgcatggtccaaactattaatatcttggagaagttcctgattcctcacttttctcataaaccctgtagtcaattcatcagcatatcttttgctcattcctcaaaatatatgtagaatcccatcacatctctctacttccactgctccatcctaacaagcctacgtcttataacccctgaataacttcaacagtaatctactggactcttggctccccaacaatctaatctttataagagtaagccttttaaaataccattcaatcatgtcactcctctgcttatctttcccaccaatatcttctcatcacactcagatcaaaagtcagtctttattgaagccttcaagcctttaaaaattctagcccctgttacttctctgaattacttgctaccactttccatcttgcccaccctactccaactacagttcttactgaccctaggcatatacttaccttagggttgtccattccccatatatccaaatgaccaactgcttcatctcttttaagtctttacccaaatatcactttattaatggggcctaaactagccattgttcttaaaattatagacaattctgactcttagccctgatctttcttatcttactcagctctatttttacatcatttattatctaccattttatgtatatggagatactcagtttaaaggttgctataatgctcaaaactatagagtaacaattctgggtttacattgagagttagaatgtcaatgaagtgctaagtatgaaacagtcaacagggttaagaattctaaaatgagcaaaggacatacacacacacacacacacacgtacacacacatacatcaaagaaagtgaattgattatatagagataattaatttaatatacatatatactatacacttacatttagtgcatgggtgcatggtttacagtcttggtgattacaagaataagatattacaaataaggaagataaaataaagaggcagttttgtgaggaaagacactggttcagttttagatatttaatcataaaggtccccctttctttctcgtgctaaaagtgttacaaactagattcgttacttcttaaatgacccttttatttggaaatgtttctcaaagaatatttaggaacaaggtaacttcaacataaacacagtttaaaacaattgttctgtttttctccttatttcttcacatgtgggagagccatctgtaattttatatctcttgcatggtaagaagtcgcagtttcaattacatttgatcatatgtattaagtgtaaacctatggtgtgagcgatgacaaagacagagtgcctaaccacctctatttgaagtcccctaggacttgggttaattaatgagactcatcctaaggttatacatgatctattacttcctctaattagaaataataatcctgatcattatgctggttagctggaaagaaataagatgaatgtgcttaactatgattaatagtcttctttaagcagtgtagatctcttctgtcactgaagttatatgcaaactgggctgcaactcaatgctttttaatgatacatactttttaaagctcatggaaaaaattaactttatggtagatctttttacctttcttgataataaacaaacattttggtattttaaaattgataaatacaacacaaaattactattttttcattttgcatataatagctatccagaactttattcttttattttttttctccaaaactatgtggctatatatgtgtattctattttggtcctttctgctgaggtacaacaggcttttgcacatgattatataccaactttttttaattcaaaaaattattactacacatatggtatttttttaactggtgtttttttagggctgatttctatacttgtcccactcacaattttagctgacacttttatatgtcaaagaaagttataaaaagttattatctggttagagagatgaaacacttccacaaagaatgttaatcatctaagatttttaatgtgactaatttagctgtaataaggtcgaatatttcagattattttaaaatagaaaataaaatcaaacatattactatgtaggtttaaaacctttaaaacactgcatgtactatttaattttggttttgatgtccgggcaaattgaggtatgattatgaaaatcttggaaaactgagattagaggagttaaaattctgttgcatacataaattgtatctcaaagcctgcagcaatataaaagcacacagaagaacaagatgttcagaagtttagcagttacatacatgttaaaaaattttaagcaaagagacagggtgtcttgggagtgaaacacataaactctagtcagatggtcttcattcaaaccttggttttaccactgactgtgcccttggggaagttatctcacttctgaacatcaacatgattttgaaaatgatgataataatggtattgatctcatatgtttattgagagaattaaacaagctaatatgtataaaataccatcataatgcttaagctatcctatttaacaaatgatatatgcttcccatctgtgatgagaagtatgtgcctagtcatgtgaaatacaattagatttcagaattaggcttccctttcattaatttcattccaggaacccagagtagctgaagatttaaacttatcaatattaggcatccacgtattgaattaaaatgttgatttttttcaataaaaattttataggataatttaattaatttttttgctaataaaattgtggatagattttatatttgacagctcctatgaaatttctaaacatatggatatgagttccaaaatgtacatcttgatttacttttttaaaattaaattttctgttctctaatatataataattttattattcagaattccctccttttatatttgagtttaataatttatgaaaaattttctattcacaatggatttttagataaaaaacaaacagtaacttagttatcaatatttaataaattattattaaattttaatgacattcaagatgataaagaagcaagcatttaggcatcttctctgtgccctgaactgtgctctcatattgaaaaaatacaaaagacataatctatagtatcagaaataaaataagaaataaaaaaagatgatagaaaatcaaatataatgaatgcaagtgtgtgacatactgtttgtatgttaaattgttggtaaatattcccagagaatgtgaaacttgaagtataggcagttggaacacaaaaacataagtagaaaaacatacttaaatccacaatttcataaattaagccaacgttattgaccatttttctgttgaagtaagaaacacaggtaaaaaatagaggtaagtaaatgttatacattcaccccatacaatgtcttaaaatgctattcttgatgccacaggcggtaaagataacttacacgtttttatataatagtattaaaaaatgactacctgtgtttatttaacctagatatatatttgaggtttaaattttgacttaaaattttgacttaaaaatttgaaagctagaaatatattacaatacattctttattattaaaaatatttatttagaaaaaaatgcattcagagttcattttcttctttcctaaagtcttttttgctatcagagtgactcttcatatcatacccatactaaatataaatatatagagagatataaagtatacctgtaaataaataacacatatgtatttaataagtgtgtatatttagcaataattttcaaatctttcaaaagatctcttgccaatttgagtttaaatggagataaaatcataaatgattaatttaaccagaatgttactctgtcaatcaaccgtaagactgacatcttgataaattaataaagatctttctgaaagagtctactaagctaatatgcagattaaacaaatgtgttgatagctgaacatatgcccctttagagcctagaagtatcaaatatgaaacctactaaaattttgatttaaaaaatcatacctgcaggccttgtccatctacagtaacagagttggctctttgcattttattcttgtcaatcactttgtttggctgctgggaaccactcttttcctttttcactgttgattgtctttcctgtaaaaaagaaaattttgataaaaataaaaattaggaaaataacataataaaatgttaagttgtttttactaatagaagagtttcatggttacaaacacaggctcaactttctaatttgaagttcctagtgaataatatgaaagctgttgttttcaactggctcaatatatatgatagcttcatgatcgaaccaccatttaaagaaataatgagaaagaataccaaattgtattatccctatgtgcccaattatgactctttatcaaaagttactaacgattactgaagttgattattttcatatgtaatgatacagataaagggtacaggattataatttaaagaatgtggtattgagtactaagaaaagcttataaatacatgcaatattgaaaattatttttaattgcatgatggacttttaagctactatttatatcaaaaatagcatatatcttaaaactgacattccatcccagctaattactttgttcctcatagtaaaaaaatttcttttaggagttgcctgctccctgtttctatttcctctcttttcactctctcttaacacaacccaatcaacttgtatcaccattactccaccaaactatcttttactaaaatcaccaatgaccgtctcagtttcacatctaatgatcagtcttcatcttctcaaatctttcagcagcatctgacagaattgatctcttcttactctttgaaaacttgcctcacgtggcttccaggacacttctttctctgagctctcttcttccttcacaacttcgccctcatagtctcttttgcccattgcttctccagctttgccacctgtaagactcagcctcttccttggacctctcatcatctctatctaccctcactccctaggtaacttcattcattcccacaactttcaatttcatttttatgaagatttctaaatgtataattcttgttctgatttctacctgagccttaatttccacatgcagatgctgtttctgtatgtccacatgaaggcctaaagcacaacattgtaaaatgtccaagattagttttaaaatttcctgcctactctgtccctagaaaataaatctcaaactggatgacaactcaccacctgcctcattacatggcttaaacatccattatctttttgtgcttggattattgtaactatcacctaatgaatcattctacttccatttttgtctccctacactcagttctctacacaaaagccaaactcatcccttttttttaccctactccagctgcactggcttcctcattgttccttgatcataacaatcatgctttaaattcagagctcttgcaatcattctgcagtctgctggaaaacttgccactgcacatttgtgggccttggtcctgacttcaggatgtggtcaaatgtcagagaagtttctctagtcccttgagcctccttttaaaacatcaattattacaacctaaagtattatttatctgatttgtttaattgtctgcattctttcatcttaatcaaagttccataagcaaaagaactttctttgtgtcactggtctatatcagatcctaaatcagtgactaacaaaagtcaggataaatcaagaaataaatgaaaacttttttgaaaagttttctaagttcttgaagcaactgttgagaaggattcttagggattttaggcttgatgtgaaaaattgtcctaattgattggcaatgcatgccatgggtgcttaagtgctttagtgccacacatttcctatcacttactcagctatatatatttcctagttcctatatttgcttgttagagtaccatttcaatttctataatttagaaagatcggattttatttgtgcaaatgtatggggtaactgagaaatgttttacatgtaaagggtatttagagtgatcattgcccaagtacaatacatttattaagtataatcacccttctctgctatcaagcattgaatttattcctagaaagacatttttaaatagctttgaaagtaaagctgtttttaaatatattagggctagatggatcagaaatcgtctctgactaaaataatgctaatcaatatagtccatttaccttgcaattccatggtgcaaaaacactgaatatattttgtgtgtggctgaaaatggatgccataataggattcctgaaattcaagtcgtttggaaagtgatgtgctttcatataagcataatttctggcaaaaatattgatttttaaaagaaagttccttctttttaagtttgcaaattataattttattcatagatagttaaatggcataatgtatataggagtgaattattagatgaggtctcgaatcagaatgcctgagttgaatctcatctctactacctaagtattatgtaacctagagggtttatgctttggcaaaatggagatagtgatacctatttctcagagttgtgtaaggtttaatataaaatgtatagtctgtaatattgtcactacattaaagtatgtattcaatataacagttactatgaatgatgtaaaatagttgtggttgcctttttgggtactcatcaacattgtttttatatttccaaatgtgtgtgtgtatgaaaaaacattcagtggttacgtcaggaacatatttaaaatttaaaagttcaacgcttatatttgaaaatgcatagcttgtgttagctgttcaaaaacttaatgctgttggtgagtgtggaaataatttactccagcattcttgcatgcatatatataaaacatggcatcaatattttgtaaaaatctgcaatgtgaaagatataccttaatacagttattcttcctaattatccaacaattgttgtttggcattcaatttataaaatgcttacacttgaagaattaaataaaattcaatttgattagttacaatggaactgggaatttgcaccagattatatatttatgttttaatggaaatttaagacatgcaagtatatgtttttaaagagctatgaaaccatctattaatatgactttacttttggccacacgtatagctagggaagttcttgtgttctaagaacctccaaatggcagagatagcagttgattaaatggcatcatgtccctccaagtagtcacccccctaagtaagttgggcaggagactaaacaattgctttagtgtaaacaatcagaaataatacaaacaggctgcatgtggtggctcacacctgtaatcccagcattttgggaggctgaagcaggcagatcgctggagcccaggagttcaagaccagcttgggcaacatggtgagcccctgtcgctactaaaaacgcaaaaatatagtcgggcatggtggtggacacctgtggtcccagttactctggaagctgaagtgggaggatcactggagtctggggatggaggttgcagtgagccaagattgtaccactgaactccatcctgagagacagagtgagactctgtctcaataaataaataaatatataaataaaaacaaattttaaaaccctaagttgagttttcaacttatgagatttcatttatgaaatccagaattatgagaaagaggtatataacaagttaatttttaaatcctcagtgtatccatctgtctgtgtattttattatagtatctaatactaaaatggtaagcattcatttaaacacaaacacacagacacacgcatcaagaaaaccaagtgatttctttggggaaaaatgcaaatgtgtggaatttgtgcaattaatccagtctaaaatcttaaaaacaggagagcctcatcactatttaatttttcttctatttccattgagaaaattgtctctcctttttatatgagggacaggaagggggaggcaactgtatcctcaaaaaatttcctgtccaccaggtttcactagcttttttgggaaggtaaattgaccctgactggcagacctctattatgatatttatgagagttaattaccaatgttgaagttattgaaagtttcagaaagagctcaccaatcttaggttgcacaatcattcaggataaaattgctctctgataataggggacaaagtttgccatttaaccttcagtttctttctttaagttttggggctctaaaccacaaaataaattacattgttgtaattaaggcaaatttccttctgccagataaatcatcctagatatacaaagagttggaaaattgttgctttaatcaatagaaattattcaaacactgaaaagagctactctaactaaaaaaaagtcatgaaagaaaatagaacatataactacaaaatataaaatacagttattgatatttgagcattttcaaatatcaaccatttgtgtttgctatgtagacattttaaatatagaattcagtgttttgtgatccgtagactccacaagtagcacaacagatcttaactggggaatatattgtattagaattccaaaagaataatcatcatcataaacagagaagaaaagccaaaaagaccattcacagaaaatagaaaggtgaaatgaataaaataaaaagacctcactttaaatatgtgctctaaaaaaaaaatctttgtctacatcatgctgattctcagaggtagagtatttgtacactggtgaaaactgctttcacaaaagggttgtttaccacaatacttaagcctgctgttatcgatcgctggcaaactgcaagcagcaagtgatgattacctcaagaacagggttttcttctttttgtccaatctcagcatgagaaactggcagcagcaaagcacctccactggtacaaagctacaaaggcgagtgctttcctgccaacagcatccatcacttgtatcgtagaacttactttccctgctactactgcacaacttgcctgaatggagatttagtcctttctgccactggagctaggccacatgaattttccagaaaccctagagtttttaacccaaggtatcatatagattcacagcagttaagatctctctgatgcagaaatgttaccacattcagcagggcttacgaaggttcggtctgagacaccaacttactaacaaactgcaaagctgcacctttaatcaatatggactgaacgtgggatttgaacattttaatggttgaaggaaacaaattcatttcaaaaatgatgaaggctctaaatctattagtaatctttggaaattgcagcaaaactatttgctgactagaaaaaacagttttgattgtttttaattataaagttttaaagataaatataataaacgatataaggtctaaagatttttatttcttttaaacttagttaagtaagtacttttaaaaaaggcaaaaacaactttttgtaaaggcaaaagtatgagtttagaagccaaattgcagctttgtcttttatttctgtgtaagcttgggcaagttatttaccattgctatgttaccacttattttaactataaattggaaagcttatgttagaaaaaagtaagaaaatttagacaaaagtactgacataaaacaggcactcagtaaatggcaatgattttaaagtatagataaaaaattttatttattttattattaagttaatcacaggtatactgcttggtcatagcagtaaaaggtaagtgttgtaagaagtatgatttatttaacatcctgtactttatttgcccactaagtcaccatagctgagaataattgctgtggtgatttgggtggtgtctttttgggagacgggggacaacaaaacagacaaaatgacaactggtcttaaagtacctgggggtgttagtcacttcctacacttgaaggtacacttggtgacttgatccataagtcccggttttcacacattacacatgaagttcatattttctcctaggatgattttatcctgggtataaaccacttacaagatttctgttaaggaaattcttattggagggaatgaaatttaggaataagagggtctatgccaaaataattcaattttggctatgtgctagtacatggcagcaccattataaaataatgtgtgtatgtctgtgtctgtgtgtgtgtgtgtgtgtgtagtatacatacacatatatgtatgtgtatactttatatacaaaagaagactttgggctaggcgcggtggctcacacctgtaatctcagcactttgggaggctgaggagggcagatcacgaggtcaggagttcgagaccagcctggccaacatggtgaaacctcatctctactaaaaatacaaaaaattagccgggcgtggtcacgtgcgcctatgatcccagctactttggcggctgaagcaggagaatcgcttgaacccgtgaggcagaggctgcagtgagccgagatcatgccactgtactccagcctgggagacagagtgagaccttgtctcaaaaaaacaaaaaaaaaaaacaacaaaaaaaaccagactttgtaaccaacctcaacattcctctttctccaatccctttgtaaaccatactgactgtcatccacagtaaactgaaagtaagtaccaggaggcagctctcttatgctcacactcattgtctctttctaccacctaagctaaatgctcaacacagtgacttattagccctcaatctgtttatgccagttctaagtaaaacttaccttgtaattgtaactgtgtaatttaattattactcaaatcattgaattttgaatacaaaatgaaagagtcatctttataaaaaataacctgcaagctttagaaagacaaaataacacaagttatgtgtgtgtgtgtgtgtggtgtgtatgaggagtggtcaagttaagtttagagagaacaactgtgcaagctttgggtattaataataaaaatagtatttttacactcagatttcttcacagatgttcttgagtttttgctatactttaaaagaattgaaactattataagtgataagattgtgatatatacaagaaaggcaagataccatttccaattagaagatctgtcctcatagaaaagcccttaatcttcaaaaatatagccaatgaatataaatgtacatattttaagttaaacatttaatgtatgtatatatctttctatatgttctcccacatatactttaaccacattttccgttaaccaaggagcaactgttcctgatggcagaacataaggtttcttgtctttctgtgtgtatatatgtgtattcacacactcagccatgcatatatccatgcatgggcttaaggaaatttttggaacaacaaagttgaaaaatcttatataatgactttgagggatactggaaagtttaagttaatgtaaaccaatatatagtgccagaaaaaaataactataggaagacttttaaaaacttcatatcaaaataaagacttttttcctgaaaattaaaaaaatatataaaaacaaaaatttggatctatttactcaatctatatgacacaaattatataactgaatgcatggggatgctttggagattaacagatctaaagagaaaagtttagatctcaaatgcaatgcctatatttgcttgattgggctggtaatcggggcagaaacaaactcaagaacctgaggatgcaaaattaattctctcacacttaaataacccaatgaaataataaactgtcctaatacttttgtcacttgagtgtgtaatttagcatctctattttataataataattgtgataataatgtcaccaactcacttaaagaatataaaatcagtttaacattttcttagattagaaacattatatttaagtgtatgtccaagtatttttgagtatgtctctggttaaaaatgagaactttttttttaatttaacgaagaggtctacactgattaaaaagccatttttggtggggagaaaagagcagttatgacacttttttacaaacatgttatcctctaaataaattcataatcttatgtagcattcatataagcaatactttctaaaataagcagattttaattacaattttagggaaacaataccatttgggcatttcctatagagataataacaattgaattggatactgtcacagaacaatgtggaggctttgcatcatcaatgcaaaggtaaagcaaaaatgttactgaaaataatgttgtggcaatgcttacatttgttttcaaaacaaaagccatttattctgactatattttattctgatgtttctctatacaatggcatgggctaggtgattaatgctgcattcatttgaaagtgatgggcacttcaaagtaagcaagagtctctcaacatactgccattgaaacttatattttgatggctcaaagaataaattcttttggatttccagcaatgtatctacattttaacgtgaaaaaatgggagtggcactatttttctatgtagtaaaaactctttgtaaagtaacctttatttttctctgtgaagtctaggtcacataacttcttgttttcttaatgcttatcacaaatatagatggaaaattcttcaagtctatcccatcactgaaaatatgaaaaccaccacttccaattagcagaatatgaaaaaaataaaatataacatgctggtattcgaatgtcactgagccagcacaaaatgttctttacagcaatacaagatgtataatgacctataattttaagtgtgaaaacctgtttttgcttacgcacctcaggaactgaaactcctgaagtgggcagagtctgctgaaaaagagaagttcatatgaaagctgaaaaagagtcaaactcaaaacaaatcagtgaagtttctcatatcattacatgcctgtgaaataaatgagtaaattaaaaatacatttccttggtataattttactgcttccttgaattaaataattaaatatcttttcattgaataagaaattatctaacacagagtgggttaggttgtgaaattatttatccaaaacacaacttcatctacccaaagcatgctgatcaacatctttggtcagctttagctccaagttccattctctttaataaataatttccactaagtttttttaatttgcccctttacccatcccaattttcattttgaagtccaactctcattctttcctaaaaatactgtgtcttttgaacacagacatagcttatgatgttcattttgttttgtgatactctggaaataagaaaacatattccattaataccagtaaaagaataaaaactataattaaataagtagcaagaattttacttgagagtaatttttttaagatggggttaaatacattgacattagtcttcacaactgtgttttccattatctaccactactacccactttgtagttcatattggaaagcctttttttttttgacaagaaatgataaaaggtcactgaattccaaaagcctgcattctatggaaatgagaacataaaatacaaatttggataattagttgacaaatcacacacacaatactagataaagtttccccatgctggaacgggagaagaaaagttggatgggatgccagttcttagatatttgtgtccctgaaaagaaggaggtagtcagaattcccttttcctccctagatacgagctatctgagggagggtctgggcagtgctagatcaccaagatgggtatgaaaaatctgatagtccagatattattatagtcccttacccaggagaactttagaaaggcagcaagaaccaaaaaaaaaaaaaaaaaaagaaaaaaatagctgaatctgagataggtaaaacctgacaccctcacagctgtgcagaatagagatggactaaaagcattcagtgcactcaaaagtgacacagaaggagaagaagaggtctagcacagccccacagaaaattaaggtgttcaggaatacagctctatttggaagatatttccataatataagtagaaagtactgtagctgcagatttctagtcaaaagaagccacgaagtggaagagtatgagctctggccaactatccattccacaggagaatctaatggaagtaattattgttgttttgaagatgaattgacagtaggtttggtagagcctttactgaaaacttcctgatttcagtaacattcttgacttctgagtccaaatcagtctacataacaccagggacaacgaatatttgtgctagtttctctctgggtcagttcaaagatatttgccaaccttattatcattctttcttagcttcgggttgaagcttaaggtctgaataaaattgcaagacatggatatagtccttccatctttatcataatatatacaagtttgttcttcaaattcaggtcaggaatgtaatcctatggatccttatcccattctgtgccatggacccaggaaactctcagagactctcaagcaaccaaaataagagacttcaatcagcctccagagcctgagtcagagatgccttttaccttagaagagtgtatgcttaccatgcatacatttgcagagagcaggcactggaaagccaagtgaaaagattatggctgtctaaatggttcagaataacaaccaaatgcaattcaagagcttcagatagatcctggtccactttcacttttaccatgcccaaaaagtaaataaataaaagcaacagaaggcattttggggataactgtagacatttgaatatggacaagataatgactgatattatggaatcattgttaattttcttaggtgagagtataataatgtcattaggtagaaaattgtccttagtcttagaaggtgcttgctgaaatatttagtgatgtggtgttaggctatgtgcagcttactttcaaaagcttcagctttatatatatatatacacatacatatatatttatatgtaaagaagtatatataaagaaattatggcaacacaatagcaattattgaatatatgtggaaaatatattggatttttttattgttagtgaatattttctaataaaatttgagagaagaaagttctttctacctcttcattatatcctttaacgcctaaaagtgtgtaaaaatgtttctacaatgaaataaaaatatgtacattatctcagtgaaaactatgaagttgctagaaggttgggagagaagtcataggagtgggtgggagagaaataaggagcactattttcatggaaacagagttctcatttaagatgagtaaatagaggtaagtttctaggctgctgggaaagaggaacagagaaagagggggaactgttaaagataaatgaaaaacaaggctttttagaaaaaagcaatatttcaattagagcagaagcccttattgacaggcatcgcacttttccaaatgtgttccttttgggtctcaaatgcagaaacccacagcggccaaaagataatacaaataggtaaaacaggtccgatgttgcaaaggtaaagactgtgccatgctggataataatcctcccatttgaagttatccaaaaaagaaaaagaaaagacactgtggtatgaaattgaaacctagctaccactttgcaattaattggcaattcatggataacatacttgaagtcttcctctttctcagagcagcaggggtatgagatatctactgatagagagcaagtgaggttggcagagaggtggtacaatgaaaaaggtaatgaaacagaggtttgtcacttcttttctgaaaataaaaaagcagtttgctaaggatgagtagcaggatcaaccaaaactgatgacccagctggagctagaagttttaaatatgtaagagagaaagccaccagccctaagaattttcttatgcaacactcagccttctgagagcaacactagaaatttactccaagaataagagtgacaaaaccaacatatatctaacctcatttacaatcaaaatgtgtaaagagttatatattaaatgtacatgcccatcagtagtttattcctgttacaatgagcaaaccatggtacttagatctaaaagaaaagtagaaacttattagaaaataaatttagctatcgtatcacttctttttttactctcctgtacttaatttttaaatatcaaagatgagcagagtaaatgttttggtttttttgaaaatcatcatgagtgcatgattctaaatgtaatatatttttaatcagaattaatacagaaactgtatatttttatttaatccaatgtgaggtgtgactacagaggaatgtgattgattttatttgatcagtatctttttaatattaaatagaatacacagtacagataattagtttaaaagatgcatttgccttcagggcactcattaagttcaatttaatatcaaagaattttttaaaattctattattcttaagtattaggatatctcttgtcttcatattttctaatgtgtaatcattttaaattgacaatttaatccaaattgtcataggacaaagaaaaatctttggtggagattattggaggtttgacttagttaagatataatgagagcacagtactcacattaaaagggtcattagttatttcaggctaaaggaaaactttaaaaatgataccttatacctacataagaacatttatatttttatatatatattttacatttatatatttttcatgtttgctatcttgcctcatttaatactcccactgaaacaagatactttatctttcaggttaggaagctgaaaatcagagagcttagatgcctaacccaggaaaacaaagttagtgacagaatattgcttccctaacccaggctctatttattcaaataacagtagttgcaagaggagactttttaaaattactatttttagccttgccttcattttttaagtggtttggaaataaaattattttaaaatattgatgaagaatgaaaaatatttagaaatcactatatctacaaagtgatacacacacacacacacacacacacacacacacacacttgttttgcctgaaaaactggcttgaataatgtgaattaatttaacacaataacttccagtgtagtagttaaagtgttccaaatatacaattggatatctctggcatcaaaaaagtagtaagagacagagaaaaaaaactagggtaagataaagaaaaattgtcttcataaaatgacactttgtcttagctggacaggtaaagttgttctctcaaacaagataataaagtgtattatctctaggatataaaaattacatatatttttggcttccatgttttttttatatttcagtttcatataatttgtttaaactttataattcttgaggtccttaattgtgtacactcacacatatgaatacaatgcaagttttaaaaaggacgtgagataaaaatgattttaatactattgttgtctttattaaaacctttagtaagagattatttcagtcataatacaagcaagacactgaaaagaaacataaattatttttcttttccacaaaaattctgatatgtctaattaagatgtaactataaaaataaaacattttaaaagctacacatattgtaatcttatccagggtcccttgactacttctcacctgactcaaattttaaagtttgcattaacagaaatttaatggtaaaatatatttttaactgtggttacttcactacccttcaactgtaattgctcacaaaatattccattcttacttagtaaatatgattgtttatgtctatttgtagagttttgtctggaggctattgacaagaagggaaccaacagaattttaaaaaataaaaacatgtatttgggggctattagagacacagaagaaattatggaggagggtagaaaacatatcaaagatagaaagcaatggagaaaaatggagacagaggaagctcttagaagaaagaaagaacaaaattctctctctgttgttttcctcaattatagaaactgttctttccaaagactgagcaaagaaaactatgaaatcgaggaggagaaagaggggagctgatatttagagcacccatcttcaaaacacatttcaaaatgaaacatgcacatcctattgactattttttcagattattcttcagaactcttaatttacatataattcattaatagatacctatttatgaatgtgtatatgtatatgtgattatgtttgtgtatgtttgggacagggatctgagggaagttggtaacttgaaaaaatcacccccttcaaagaactcagtataatagactgatacatacaaattttatgttcataaaattaatctataatatttcctgttatgcctattttatctccctataaaaacgagagccagttctagaaatatatcattgtatagttagcgtattgctgctttccagaatacaaatatagcactataggtaatgaaagtatattgataataatatttagaattaaagcctaggtctccttttcaccatccttgaaaaagatcttgaattaaaaaacaaagaggttataatggaatttgttcttgtcttttgctcctttaaatatccattgatctcatgccaaagtattttctaaccaggttaaagtccaattctgtactcacgttaggctaagattcaattgagttaaaattttacactgactgccagtcaaccttatcatgaactttcattatgtgcatgtaattaattgggtccaacgaacaatatcagttctgagttatagactcttttcccccgaccatataattagaatataattacccacaggatatcagaatgatgcagaacctttcctctaaatgcgccctcattaggaaacaagtctcaatgtacacttattcaatcagtgtgaattaattaaaatgttactgaaataaaagagggtagcgataaagagtatctgacatctattaagagtctatcactagagatctgcatgcacagtttatatttaaatccttttagccgaaatagaaactttgctatgtaatgttatatacatccagtgtactaggaaatctgagtacatacatcggtgtgtgtcatcatttttgaaaagagtacaagatacgataactatagaatctttaagaattgggtaggaatctaagagccccattattccataaatatgtcatcatcagatagaatctacctggcgggcaaaaatcattttaactcaaactacctaagcaattattggtttaacccacaaccttatattacaaatctgaaaatatttgtcccaaaattgcttaggagacaacaattcgaaaagcccagatttgtgaaaacactaattatttttgtctttataaaataacctgaattccttaagctagctcaagttattacagtagcatattttctttaagcagcacattcaaatacagctaagaatagcttctttttaagagaataaataatacatcataccacacattctgattatataaaacacatttaaaaatagtaaatgcacaaagaagctgagggacacatgatacatagcgcacaagaagctgcggattcaaacagtaacattctacctaagagctattcatctttatttctccaggtgtatagttatattcaataaaactttgctaaataaataacccgtgtacaaaggaatactcagcattagtcagaaacaatgccatgaactgttaacataaaaatttcagagctgcatgtaataaactaagatatatacatattttcaagctttcagtgttattatatattcctcagaaaattttagatacagaaaaaggttttataaaacatagttctggtaataaaaatttggcattcacttttataagtagacatgcaccactttgtaatggaaattctgcatgagtattaagataaactaggctatctacaaatgtatactttttatatgctctttaggagcaaacttcaagcagttttaaattattagtcttttttacaagaatgtttaactctataagattatatatatatgtgtgtatatatatatacatgtgtgtatacatgtatatacttgtgattacaacattcaaaaatatgttttatatacctatatatgtgtatatacacatatatacatatatatatatgcatgttgtaatcacattctggtataatattctattcagacactaaactcatcttggtggagaccaaaagtgagagaaataatggttccactctgctaagcaaatgaagattgtctcacaaaggtttgctttattcttaacctaaaatttttttagaatttcagtaataaatacatgtagctacagttgcctgctgaaaatattctattggagtaacattcactaaaatgccacattaactaagagtaattactaccaaaaagccacaatttctaaacaagagaatgtgaatatttttgaagttccattctataataaacatcaattttcattttctgaacacaaagaagaatgattatttattatattttacatggaaaactatattgcttaaattatatttaaaaatcagatttttaaatacaatttaatatccagagaaaaacatctcaattctcctcagaattctgaaaatgttccctttatattctctacctgctgtaactcctcattttacatgtgaggcattttacagtaccatctattggatattttatataactacaacacataaaactcaccagcttttcgaaatttagtagtaactataagaagctgcaagagccattccggaaactaaatacaatgctactttggtatccactaacatttcctcatcatcacacactttaaactcaattttattagcttctaacaaaatgatttaattatgagttaccaatgattttttaaaaccaagcctccttgttatatatttgttttaatttttacttgatatatatgttactgtctgatatattttttcttgactcagggaaaagagtgataaatgatgggaattttcaaaagctgactgaatgctattcattcactcagcaaatatttgttaagcatctagtctatgaccaaatcaaattaggcactagacataaagagatacacccttttgctgggagtgataagaataatgggggtgctagtcaatgagcataagggacagtttcacaagaaatgtttcaagttcaattcctgctatgttgactttaagcttctgtgggatatatctgagaggaaacttaaaacatgaagtgagggccgggtgcagtggctcatgcctgtaatcctggcactttgggaggctgaggcaagtggatcatctgaggagtttgagaccagcctggccaatatggtgaaacccatctctactaaaaaaatacaaaaattatcccggcatggtggcttgctcttgtaatcatggctactcaggaggctgacccaggagaatcgcttgaacccgggaggtggaggttgcagtgagctgagatcacgccactgcactgcagcctgggcaacaagagtgaaactccatctcaaaaataaataaataagtttatttattaaattaaaaaaaacacgaagtgagcatttcgatctagatgtatgtggggagaatgggctcatacagacacatgcaaacatggtagctgtagctctggaactggataacataatttataaagtgtgggtgtaataagatgagaattgaagaaaaaactgaagttttacacatattaaagaatgaaaggaagactagggatttagtaatattgacaaagtgtggcttaaaaggtaaaagaaaacctagtggaaatgcactggatgagtgttagaggctatcaaaggtaagcatctcagtgtcaaacactgtagagcattcaaaacagattatacttggaaagggtttccagtagatgctgttggtagctcaaagcagatcctttgctaccttgccagagcaactatcaccagctgctatgagtgttaacttctgaaagcttgcagccgtccctaagaattaacctttatccacagaaataggctgtgccaggaggccctagataatgactgacacataggtgaggaaaggccagccttcttgccttaagttaggaacaatcctatgattggatttttgctgcaaagccctaaaggtacgggccaaggctaaactatcactatgatcaacattcttgcttagagcttgcctcttcctttttctgcctccctcccttcattataggttgttttgtttttgtttttgtttttttctaaagaactttttctccctccataaatcacacaaagccaaatcttggcttaatgctctactccttaggaacccacctaaaagagtgcaattcgatttagtaaggatagcaagaacaatttcatatccatgttacagtcagaagttacactaaagtgggttgagaaggaagagaggaatgtgacacagtgggtgttatctacacacctgcacaaacatacttatggttatgtgaagagccagacaagagtcagcatgcaaatacaggaaatagaattgcacaggagaaggacaaacagccctttcactggaatgagttctacaacacactaatagtaaaaacaatattcacctactggactcaaatcatgatgctgtttagtactaaattacataagtgtgctggattataccttgtctgggtttttcctattgtaaattaggaaattgatattttattaaagatctgtgacaaatgccatgaaaggagaaaaatgtggaattccaggagaattaaggcagagaatactagaatgaaagaaatctgaaagaatatacgcattgggtggctcaaggatgttgaagaaatgataatcaaaggaagtaatttaaaaatatttgtggtcaagataaaatgagagtaatgtaatgaagaatagatcactaggtacagagccgtaatcttccagggtttgggtttccttgggcaaatgaggttgaataagtcaaagctctttagagtattagcaacagaatttcaactgatagatttttatcaactggactggacagcaaggagtggtcatggaaagctcgagaactatccttattccacataaaggggaacatgggttgaactagggaacaaagacaggcaatgagacagagatcatggtagtatttacaaaattgatgtgtggaccaaaagttatatgtgacttaattcttcaccaggtttcaagtaaaagttgagaataaacaagccatatttaatagtaaaacagagaaagtcatgtacataaatactttctgatcaccactgtttcagcaggaatcattaaaactacagattacctttgcaaggtggaatttatcccttaatgtctagtggtggttaagaatgtctggttttgactgcattcaaaatgtaaaaattaaaagataaaaatgatataaagcatttgtctctactctaatgctattagctctagatatatgccttgccccaaccccaaatttctttgaaaggtgaaagcagaaatatcaacatagaagttcacatatttgggagcttttatgccatagtttgtggcaatttagtttcaccagtgtttaatgagaatagcaaattttgcacattcttgccaacactgggtattatcattttaaaaatattttccaaaatggatagaaaaattaaatctcattgttttaatttatatttcttcattactttttacaatatagggatttggtttacaatatagggatttggtttacaatatagggatttggtttacaatatagggatttggtttacaatatagggatttggtttacaatatagggattgcattttacaatacaaagatttgttgttgctgttgttactgttattatgatccttatctttaacttgatttgtaagttttgggatttagcattttctttaaaataaattttcattgctcaaggcagttaacattttatctttctcattttggaaaaaaaaaaaaggctgtgcctaggcaaaaattaaaccctgaattcatgtttgatttttttgtaatagatgtaatgtagaatttaccttactttattttcacgtggttatacaataatcctgacgcctttgatgctccaccagatttcatttgtgacttttattatagactatataattacatatagttcaatatgtctttagactttctatcacatctttacaacttttagagccatattattttgatcactgaaaatttaacaaacatatttttaagactttttgttagaataagcatttttttattactcttcgtttttaagattttataatgtttatgtacatttattcttccagacaaaattagaaatcattttgtccagccaaaaaattgcatgcaaattgcaccaagtagataaattaatttgaagtgacgtaggttctttttcattcagtttaattttctttacacttaagagaacaatttagttttttgtttgtttgtctgtctgttttgcttagggatagcatgatctcttttcaatttgttgccattctctacagtagtaaaaggagattttcgtaatcctcttctccagattacttattttgttgtcctcagtgttgatttttgccttattctaatacagatatagttagtttctgctaaaacattatttttttctatactctttcttaattcttttgtttctttcaagtcagtgcattataaagtaaatgttttctttagtattcttgaccatctaaaactattgctattgatgtcttcttctgtttgatgcaataaaactttatgtatggcattcatctaacttttatctgccatcctttttctttatttttgagttgcataactattagtattttatttggcaacaggtagactctttaataccaaaaggcacttgggtcataaaccatcagtctgcattggcagttgatagaaaagtcaaaggaaacaaatacaactacaccgattattgcaatattgtttaggtactgtccaatacagaaacaacttcacacagaaaaattaatctaaggtctcagtaaccacaaaataataaaaaatattttctctaattgaatacaatcaagcctataatatttatttttgctaaggctaccaagaaactcagggaaattctgaaaaattacctctgttaactttgaatggtattgtgaaataaatttgagttttaacttaattttggcacaaacttactacattttattttgctgcatatggtatattacataagctgttttgaatactgttagcaataacttgtagaataatttaaatcattcatgaatacataatttcccatcctcactttagaatcagacatatataatactctttgttttaagtctatttttaaaatttagcttttaatacattgtaatctctctttggataatgctcatgtatggctatatgtttaagatttcccgacaccatcaagatggctgactagaggaacctagcactcatctcttaaacaaagaagggccacaacagcaaataaataaccacaaatcaaatggagcatctaagggagaacacaaattcagcaagaaaatgatgaagcccttctaagacatggaaactcctgatggcacaataaaaataaaagcaaagcagctagccaggatcagcatagaggcaggagagactctccattgcaggaaaaaggtaggtgggagattccccagccatctacattcccatcagagatgtctggaatcctagggagagaaaagcccctctgccctcacagaccccgagcctagtgcagagagtttcctggagttcacatgactgtattgttccagagaggaaaatcaaactgggtgccctacactcctgggaccaaagctgatgcatcatggcattattttgagggaagaaccatcaccagaatacattctgacttgggccaaatagcccctgtatctccacatccatagtattccactgatattcccctacatccactgagaaggctacagtctcatgaaaccaactggaactggtggtacaactgtgttcccagcatctgagcccatgtagctccctgtactccagaaaataggtgatctaaacccttaggaagtctgcctccaggacacaggtagctgaagcatgtgcacaccaaagcttgagagccacctgtcttatctgccgtcaccaacagtgacctctccccctctagcagtggggccaccacatgtccatgtgcaatgtcaataacctgcaaaccagtttaactggggtccactgccagtgccccaatgtgtgccatccaggagcccgaggccatcctcctcaggaattgctaccacttcaagcccaaaaaactgacctctccaatagtggggctgctgcgcacctttgcacaccatttaggagccagaggagtggaccaaccagggtctactgccaccaacacccatgcctacaaatatcccccaggatcctgaagactggcctacctgggctctcccaaagaaagttatgacagagcctccacaaacaactacagcctaaactactgagaaaatcacatatgctactgatttgattacaggcaaaaaaaaaaaaaatcatatggagaatacattactgtacctacctagaactaaaaccaaagcactctacctaactgactctatagatacatctacaggaaaaaaagtgttaccctatgaaagctacttcagaaaattcaaagaagtgacagctatatcagagatgtagatatcagtgtagggatgcaggaaacatgacaaaccaataaaacataacacctctaaaggaaaataattattctgcagtaacagaccacaaataaaagaaaatctataaactacttgaaagggaattcaaaataattatctttcaaaaattcagtgaaatacaagagaacacagataggcaataccgtgatatcaagaaaagaattcatgatctgaatgagaaattcaacaaagatgtccaacagaaatcatagaactgaagaattcaatgaaaatataaaaagtacagttgagagcttcaacaattacagaagaaataatttccgagcttaaagacagatcttttgaagtatcctagtcacacacaaaaaaaagagaaaaagaatttttaaaaagagtgaagaaactctatgtacatacaggagaactttaagcaaacacatttttaaattctgggagttccaaaaagaaaagatggggaaagacatggaaacctattgaataaaataatacttgaaaatatcctatgtcttgggagataaatagacatccagatacaggacactcaataatcctcaaatagacttaaattaaaaaggtcctatcgatggcgacaggggacagacaaattcctaggcagacagggatgggtctccagtgaaacccaaccttccagcaaaggacagtttaaagcctgaaaaccaagctgccagttccagatagactccacaactggcatgagaacttctatctccatctcacccactcagtcttgattggttccttctgaatgatgccttttaactaatcaaatgatatttttttcaagaccaaccatggacccatcagcatgcattccccgattctaagcccataaaaaccccagactcagactcacaaatggctacctgtttaggggtcctctctcattgccgagagctttccttcagtgactcaatacaattctactatatcttactcactttctggtgtgcacataccttgatccttttggtcacggacaagaaactggaaatccttgaactgcaggagcaaaagagctgtaatgttcctgcttgctgagctataggtggtgagaataaaagagtggtaatattctctgccgctcgccgaacaacaggacagaaaaacccactgggtgccaccttctcctgcttgctgaacaatggcagcaaagagccactgggtgccctttctctcactcactgaactgtggaagcgaaaaagccacaacactatctgaggcacattatagtcaaacagtcaacagtcaatgataacaagagaaaagaatcaagtcacatacaagggagtccccattagactaacaacacacttctcagaagaaaccatatggtcagaagagcatgagatgatatattcaaaatgctaaaagaaaaaaaaaaacctgtcagccaagaatacaatacccagcaaagctatcttaaagaaataaagagtaaagttttctcagacaagcaaaaactgagggaattcatcatcaccagactggatatacaagaaataagggagttcaacatctgaaggcaaaaggatgatatctgccattatgataacaaatgagaaagacaaggaatgaaatgttatttctacagaaaacaagcaaactgcaaaaaataacttaagagagaaagagagaaacaaaacaaatacaaaacaatcagaaaacaaataccaatgggtagttagtcttcacctatcaacaactatgaagaggtttaattcaccaattaaaagatagagatttggctgaatggattaaaaaacaacaagatccaactatatgctgcctacaaaaatctcacttcacttgcaaagacactcatagactgaaagcaaaggaatagaaaaagatattccaatgcaaactgaaacgaaaagtaggcaggattatctatatttgtatcagacaaagtagactttaagtcaaaaaacataaaaacagacaaagaaggtcattagataaaaattaagtggtcaattcagtaagaggatataacaattatagaaaagtaaataaacatatatatacacactcaacattggagaccataatacaataatagctaggaacttcaatgccccacattgagtattagacagataatctaaaaggataataaattgtaaaatattggacttacactgcactatagaccaaatgaacccaatagatatttacagagtatttcatccaatagctgcagaacacacattattctcctcaggacatgggacatttgcaaggatagactgtatcttaggcctcaatataaatctcaaacattttaaaacatcaaaattctctcaagcatcttctcagaacacaataaaataaaatcagaatcaatattaagaagaactttggaaattgtacaaatacatggaaattaaacaacatgctcctgaatgacaaacaggtcaataaggaaattaagaagaaagtaaaaaaaattcttgaagacatgaaaatagaaatacctatgggatagagcaaaagaagtgctaagagggaagattacaccaatgaacacctatataaaaaattaaaatatttaaaataaacaacctaacaatacacctcaagaaactagaaaagcaagaacaaactaaattcaaaatttatggaagaaaaaaataataaagatcaaagcagaactaaacaaaatagagactaaaaaattacaaacagtcaacaaaatgaaaagttagttttctgaaaagataaactaaaacgacaattagactaagaaataataaagaaaacctcaataaataaaaccagaaacaaaaaaggagacattacaactgataccacataaatacaaaggatcattagaaactgttatgaacaactatacactaccacactgggtaatctagaggaaacatataaattcctggaaaacttacaacctgccaaaattgaaccaagaagaaatagaaaatctgaacagaccaattacaagtaacaagactgaatcagaaataaaaagtctcccaaaaagaaaacaacaacaacaacaacaacaacaaggcccaggacagagagttttactgctgaattcaaccaaacttttaaagacaaacgaaaccaattatttttaaattactccaaaaacaaaaaaatagaccatacttcttaattcactttataagtacagcatcaccctgataacaaaacgaaacacagacacaaaacaacaacaaactacaggccaatatccctgatgaatatgggtgtaaaaatcctctaccaaataatagcaaagcaaattcaacatcacatcaaaaagataattcatgggggaggagccaagatggccgaatagtaacagctcgggtctacagctcccagcatgaacgacgcagaagacgggtgatttctgcatttccatctgaggtaccgggttcatctcactagggagtgccagacagtgggcgcaggtcagtggtcgcgcgcaccatgcgcgagccgaagcagggcgaggcattgcctcacttgggaagcgcaaggggtcagggagttccctttctgagtcaaagaaaggggtgacggacagcacctggaaaatcgggtcactcccaccagaatactgtgcttttctgacgggcttaaaaaatggcgcaccatgagattatatcctgcacctggctcagagggtcctacgcccacggagtctcgctgattgctagcacagcagtctgagatcaaactgcaaggcggcagcgaggctgggggaggggcgcccaccattgcccaggcttgattaggtaaacaaagctgccaggaagctggaactgggtggagcccaccacagctcaaggaggcctgcctgcctctgtaggctccacctctgggggcaaggcacagacaaacaaaaagacagcagtaacctctgcagacttaaatgtccctgtctgacagctttgaagagagcagtagttctcccagcatgcagctggagatctgagaacgggcagactgcctcctcaagtgggtccctgacccctgacccccgagcagcctaactgggaggcaccccccagcaggggcacactcacacctcacagggcagggtactccaacagacctgcagctgagggtcctctctgttagacggaaaactaacaaacagaaaggacatccacaccaaaaacccatctgtacatcaccatcatcaaacaccaaaagtagataaaaccacaaagatggggaaaaaacagaacaggaaaactggaaactctaaaaagcagagcgcctctcctcctccaaaggaatgcagttcctcaccagcaacggaacaaagctggatggagaatgactttgacgagctgagagaagaaggcttcagtcgatcaaattactctgagctacgggaggacattctaaccaaaggcaaagaagttgaaaaccttgaaaaaaatttagaagaatgtataactagaataaccaatacagagaagtgcttaaaggagctgatggagctgaaaaccaaggctcgagagctacatgaagaatgcagaagcctcaggagctgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacatgctgcaggatattatccaggagaacttccccaatctagcaaggcaggccaacgttcagattcaggaaatacagagaacgccacaaagatactcctcgagaagggcaactgtaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagacagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaccagttgctgcaaaatcatgacaaaatgtaaagaccatcaacactaggaagaaactgcatcaactaacgagcaaaatcaccagctaacatcataatgacaggatcaaattcacacataacactattaactttaaatgtaaatggacaaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaactagaagagctaactatcctaaatatatatgcacccaatacaggagcacccagattcataaagcaagtcctgagtgacctacaaagagacttagactcccacgcattaataaagggagactttaacaccccactgtcaacattggacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaagagctggttttttgaaaggatcaacaaaattgatagaccgctagcaagactaataaagaaaaaaagagagaaggatcaaatagacgcaataaaaaatgataaaggggatatcaccacagatcccacagaaatacaaactaccatcagagaataatacaaacacctctacgcaaataaactagaaaatctagaagaaatggataaactcctcgacacatacactctcccaagactaaaccaggaagaagttgaatctcttaatagaccaataacaggagctgaaactgtggcaataatcaatagcttaccaaccaaaaagagtccagcaccagatggattcacagccgaattctaccagaggtacaaggaggagctggtaccattccttctgaaactattccaatcaatagaaaaagagggaatcctccctaactcatttgatgaggccagcatcattctgataccaaagccaggcagagacacaacaaaaaaagagaattttagaccaatatccttgatgaacattgatgcaaaaaatcctcaataaaatactggcaaaccgaatccagcagcacatcaaaaagcttatccaccatgatcaagtgggcttcatccctgggatgcaaggctggttcaatacacgcaaatcaataaatgtaatccagcatataaacagagccaaagacaaaaaccacatgaatatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaagtctacagtaacccaaacagcacggtactggtaccaaaacagagatatagattaatggaacagaacagagccctcagaaataacgccgcatatctacaactatccgatctttgacaaacttgagaaaaacaagcaatggggaaaggattccctgtttaataaatggtgctgggaaaactggcaagccatatgtagaaagctgaaactggatcccttccttacaccttattcaaaaatcaattcaagatggattaaagacttaaacgttagacctaaaaccataaaaaccctagaagaaaacctaggctttaccattcgggacataggcatgggcaaggacttcctgtctaaaacaccaaaagcaatggcaacaaaagccaaaattgacaaatgggatctaattaaagtaaagagcttctgcacagcaaaagaaactaccatcagagtgaacaggcaacctacagaatgggagaaaattttcgcaatctactcatctgacaaagggctaataatatccagaatctacaatgaactcaaacaaattcacaagaaaaaaacaaacaaccccatcaaaaagtgggcaaagtatatgaacagacacttctcaaaagaagacatttatgcagccaaaaaaacacatgaaaaaatgctcatcatcactggccatcagagaaatgcaaatcaaaaccataatgagataccatctcacaccagttagaatggcaatcattaaaaagtcaggaaacaacaggtgctggagtggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaacagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaatcatcattctcagtaaactactgcaagaacaaaaaaccaaacaccgcatattctcactcataggtgggaattgaacaatgagatcacatggacacaggaaggagaatatcacactctggggactgttgtggggtgggggtaggggggagggatagcatcgggagatatacctaatgctagatgacgagttagtgggttcagcgcaccagcatggcacatgtatgcatatgtaactaacctgcacaatgtgcacatgtactctaaaacttaaagtataatttaaaaaaaaaaagataattcaccatgatcaagtaggagttatcccagggttgcaaagatggttcatatatgcaaatcaataaatgtgatataatacatcaatagaataaaggaaaaagtcttacgatcatcataatagaaaccaaaacaaagcaattcataaatcttcatcctaaaatttcttcatcataaagtctctcaaaaattggacatagaattagatatacccctacacaataaaggccatttatgacaaacccacaactaacagtacactgaacagagaaaagcttaaagcattttctacaagaactggaataggacaagtatgcctacttttaccactcttattcaacatactactagcagacctaggcagagcagtttggcaacaggatgaaataaagggcatccaaattggaaaagaggatgtcaacttatccctccttgtaaatgagataatcttacatatagaaaaacctgaagacttcacaaaaaactcttatgactaagaaatgagtttaataaagttgcaggatataaaaattaacatacaaaaaaatcagtagcattcctatttaccaaaaacaagctagctgaaaaggaactggagaaggaaatcccatttataatagcttaaataaaataataaaatacttaggaataaatttaaccaaggaggtaaataatctctacaattaaaactgcaaaacactgatgaaaaaaattgaagagggcataaaaatcaaaagacatgccatgctcatggattagaacagttaatattgtcaaaatgaccatacaacccaaagcaatttatagattcaatgtaatccctattaaaaattgcaattacatttttcttcaaataaatagggaaaaatcctaaaatttgtattgaacccaaacaaatacaagtagtcaaagtaatactgagcaaagggaggaataacactatgtgacttccaagtatatcacaaagcaatagtaaccaaaacagcatagcattgctataaaaactgacacacagacaaatagaacagtatagagaacactgaaacaaatctatgtattttacagtcaactcacttttgacataggctctaagaacatacactggggaaaagacaccctctataataaatggtgttgagaaaactggatattcatatgcagaggaataaaaccagatccccatctttcaccagaaccaaaaattgacacaaaatatattaacaacttaaatgtaagacccaaaactataaaactactagaaaaaaacagagggggatttctttgggactctggtctgagcaaagatttttatggataaggttacaaaggcacaggtaccaaaaagaaaaatggacaaacaagactatatgaaacttttaaagagcttttgctcagcgaaggaaacaatcacagagtgaacagacaatctgtatattgggagaaaatatctacaaactatttacctgacaagggccttttacctagaatatacaaggaactcaaacaacttaacagcaataataataatggtaataatcccattaagaggtggaaaagaatctgaaagacatttctcagaagaagaaatacaaatggccaaaaagtatataaaaaatgttcagcatcactaatcatcagggaaatgcaaatcaaaaccaccataagatatcacctcaccccagttagaatggctattatcaaaaagacaaaaaataagaaatactggctaggatgcagagaaaagggaattcatacattgttggaaggaattatagttagtacaactattatgaaaaacagtatggaggttccttaaaaaactaaaaatagaaatatcatataatccagcaatcctgttattgggtatttagccaaaggaaaggaaacttgtgtatcaaagtgacatcttcacccccatgtttataacagcactattcactatagccaagatgtgatatcaacctaaatgtccatcaatagatgagtagataaaataattatggtatatatgcacaatggaatactattcaaccataaaaagaaatgggacgttgtcattttttgcaacatggatgaacctgaagggcattatgttaaattagtcaagcacagaaagatcaataccacattcttacttatatatgggatctaaaaaattgagctcatgaaataaaagggtagaattgtggttttcagaggctgagaagttagggatgagaaaggcaaagagagaagttggttaactgatacaaaattacagctagacataataaataagttatgttctatagcactataatgtgaatagagctaacaataatttattgtgtatgttcaaaaagctagactggagaattatgaatatttccaatacgaagaaatgataaatgttttaggtgatggttatactaattactctgatttaatcactgcatatttcatacaggcatcaaaatatcattctgcatcctataaatatgtaaaattattatggtaactatagataaagtgaaggaaacaaaaaatgcaaaaaaccaaccaaaatcatgtaaatacaatttttaaagaatttttatgacttcattattatttttgatttgtgggactatatatttcacagcaatttcaatgtaccttctagatattatatagacacctatgatctgaacttaaagttttagaagatttctacctataataggtttttggatatttaaattttggtttttttttctaggtttgaggtcagcgaagaaaattgacattttaaattaatataggaatgatggcctaattaatcttcttgacagtgaactcctgtgtgtcaagagtcaatccataggacactgcatcctgaatatattaacttcccaattgttcatatattaaactaaaagattttcatcagatttcttcttagctgaacttccaattcatgtcttatggggcttttgtttggcttttccataaatcatggcaaaccaaatgtggcacaagtttgatttttgaaaaaaattattattgcttaccctgggtacagttatacatataggatatatatacagtatatatataggatatatacacacacacacacacacatatcctatatatatggtatatatatacatatccctgtttaaaaaatccctttaagtatacaactctaccttatgcatttaggtagaaacaaaaacaattgtctacaacacttgaactttttcttttagactagaccctgtttataattatacacgttctacataatataaactagttcaatgtaaagacagtttgtcagaaagcaacagcacacagccaatctgagacaatgtaacagataaatggttggttaacctcccaagggtaagattatgaaatcacttagtgaggctgggtcccttccagttttcttatgctatgtctctttaaaatatatgtacatgaagaaatacacggacatgctatgactctttaaaatacatgtacatgaagaatattttaaaccaaaatggatgtacacatgttttataaatattatagcaccctagttcttaatgtgttcctcatcagaatttgaatagtgagaatgtaatcctacacatttaaaaaattaaataaataaaaggcagctatcctttatgaataataccatgaaattgagtctgagttagatttccaaaatatggaaaaatgaggtttctttttgcctatcattactatgatgacaattatgaattgatctataatgaatattaattaaatgaatattaagtaatgacactgatgaaacatttattgagagctgacaatatgctttatccctgctctttcaacaaaaaagaacgttgcataggcacaaacctttggtagatgacataggatttcaaggaaatagatgacttcagtaactttgcttaaaggttaaagaggtaaatttaaaagaagggtgaaacagccataatgatgtgaaataaaagctgaagctcagtgcagcaagacacatccttagttagttatatgttcacacctccccaccagactctgcatttctggaagttttataactagcctaggaataatattacagagaattcaaaattcaaatttcagaatcacagaagatttgaatatctcccaccctccttgaattagctgatgtgtagcattgggattgtcattattaactcttgccgataaaagtcagatgaaaaaatctacagaaagtttccatactactggagctgtgagaaagagacacacaccatacttctacttcctaacaaactttctgacattgctgagaaataatgacttagttcaacacatgctctaaggaaagatttaacatactctatgctatttaagacttaatcaccatatttacaatgcataatttagtagaattcttaaaattgtggaagagcaagcaagatcggaagaagaggagaagttaatatgacatatggttttctgagggtgttataggtagagatacgtagattgctgcttcagcaacatcacaacttagccaagttttcagagttacagtgaagaaaaaagagatgcagaactgggaccattttaagtttcagcaacatagatggaactggaggtcaatatgataggtgaaataagccaagcacagaaagattaatattacatgttctcattcatatgtgggagttaaaaagttaattccatgcgggtagagagtagaatgatggttatcagaggatgggaagagtttgcatgtttgtggagtagggggataaagagaggttggttaatggatacaaacacgaggttagatagaagaaataaattttaatgttcaatagtagagtagaatgacgatagtttcacacattgtatgtttcaaaatagctggaagagaggacttcccaacataaagaaataatgaaatactcaaggtgatgtataccctaaataccctgacctgatcattacacattttatgcatgtaacaaaatattacatgtaccccataaacatgtacaaatattatatatcaatacagaataaaattcatattttatatttataattttaataaatatgatttaaaaattacgtttataaaacaggattaattaattttaatactaaagaatattttttaaatatacatttttcaaatagttttgttgtcctttctgtgaactaacaagcttcataatttatcttgatggtatttttattaactctattcttcttttttaaactttactttaaagttctgggatacatgcgcagaatgtgcaggtttgttccacaggtatacatgtgccatggtggtttgctgcacctatcaacccatcatctaggtttcaagccccacatgcattaggtatttgtcctaatgttctccctcccctaaccccctaccactcgacaggccctggtgtgtgatgttcccttccctgtgcccatgtgttctcattgtattaactctattcttaaaggctcatcagatattataacaagagagtgtattccaggaagaacacaccataactggtctaaagggctatggtgctgaacatattcattgtttcacatcctatcatttcctgctaatggacagtaataatatggttaagttcaaaagtgagataaattaccctgggcagtatggcaattttcacgatattgattcttcctacccatgagcatggaatgttcttccatttgtttgtatcctcttttatttccttgagcagtagtttgtagttctccttgaagaggtccttcacatcccttgtaaggtggattcctaggtattttattctccttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaactgccctggccagaacttccaacactatgttgagtaggagtggtgagagagggcatccctgtcttgtgccagttttcaaagggaatgcttccagtttttgcccattcagtatgatattggctgtgggtttgtcatagatagctctaactattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtgtattgaaccagccttgcatcccagggatgaagcccacatgatcatggtggataagctttttgatgtgctgctggatttgttttgccagtattttattgaggatatttgcatcaatgttcctcaaggatattggtctaaaattctcttttttggttgtgtctctgcccggctttggtatcaggatgatgctggcctcatcaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcttcctggtttagtcttaggagactgtatgtgtcgaggaatttatccatttcttctagattttctagtttatttgcgtagaggtgtttgcagtattctctgatggtagtttgtatttctgtgggatcggtggtgatatcccctttatcatttttattgcgtctatttgattcttctctctttttttctttattagtcttgctagcggtttatcaattttgatgccatccccatcaagctaccaacgactttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaacccaaacagcatgctactggtaccaaaacagagatatagatcaatggaacagaacagaaccctcagaaataatgccacatatctacaactatctgatctttgacaaacctgagaaaaacaagcaatggggaaaggattccctatttaataaatggtgctgggaaaactggctagccatatttagaaagctgaaactggatcccttccttacaccttatacaaaaatcaattcaagatggattaaagacttaaatgttagacctaaaaccacaaagaccctagaagaaaacctaggctttaccattcgggacataggcatgggcaaggacttcgtgtctaaaacaccaaaagcaatggcaacaaaagccaaaattgacaaatgggatctaattaaactaaagagcttctgcacagcaaaagaagctaccatctgagtgaacaggcaacctacagaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccgtcactggccatcagagaaatgctaatcaaaaccacaatgagataccatctcacaccagttagaatggcaatcattaaaaagtcaggaaacaacaggtgctggagaggatgtggagaaataggaacacttttacactgctggtaggactgtaaactagttcagccattgtggaagtcagtgtggcgattcctcagggatctagaactagaaataccatttgacccagccatcccattaccgggtatatacccaaaggactataaatcatgctgctataaagacacatgcacacgtatgtttattgcggcattattcacaatagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaagcatcattctcagtaaactatctcaagaacaaaaaaccaaacaccgcatattctcactcataggtgggaaatgaacaatgagaacacatggacacaggaaggggaacatcacactctggggcccgttgtggggtggggttaggggagagggatatcaatgggagatatacctaatgctagatgacgagttagtgggtgcagcgcaccagcatggcacatgtatacatatgtaactaacctgcatgttgtgcacatgtaccctaaaacttaaagtataataattaaaaaaaataaaaataaaaataaaaaaagagatatgagagttggcaggggctagaaatccagtttaaaaaaaaagtgagataaataatcatctaaaaatgattttaaaattttaaataattttctattctaagacaaatgttctgttttaggaaatatttaatcattattttcttcattaggaatgggtttatagtacagaaagaattaaacaaccataaaagcggactcatttgtaggacaaaataacacagtatggggaaaatgatcctttgcacttctgagtagagaacagccagaagaaaccattcttcataaagatgttcactatcatgttacttataataacaaaatgaggaattgaaaagatgctagacaaaaacagtttcaactaaaatatgacttctttacttaatgagattacacaggcattaacagtgatgtcccatagtatatggaaatacataaaaatttaaggatatcaagttaagtgttaaaatataatgccacatggtatattcaggttaactttaaaaaggtgaaaaaaaaacctaaaaatcaggaaggtaattttaatagtgtttctatttatatattaattgtaattcttcttatataactgtatcacaggtttttaaatgtttaaattctttttctttattattttaaaattttgtatgattacatagttatggtatgataaaatgttaaaattcacttttcaaattacagcataacacttataatagtaatattagatgatatcatcttagcactcaccatcagctatgcatagttataagcaattttcatgaattaactcatttgattttatttacaaatggaatacagagggacaaaatgttaatagctcgcttcatatcacaaaactagtgaaaaacccaggattaaaatacaaatggtatactgccagagttctaaggtaactgaaccaatttactctctcacctgcaatggatgaacaatttggctgaatcttaacaaagcttaggctttttaacgtgcttgtatcattctcttcagtgtctggtgttatctcctgatacttaacatcaattttcttgataagtaatgatggtgagtgcatattcatatgtttataggtggtttatcaatagacttagttcaaatgcctgtttaggtctcttgcccttttcaactgaattgtttgtttattattgatctatatcaattctttttatatttcacatacaagtcatttgccaccattttgaaactactggatggaaacgacttgcccacagatcaggagttcatgtaagaactctggactctagtcttccacactttctggctatcattattctctcttccttctttctcttcttccttttctttccttctcttctttcttttcttttcccttcctcccttcctcccttcctcccttccttccttccctccttccctccttcccgctcccctcccctccactcccctcccttccctcacttccttccttccttccttctttcctcccttcctttctctctctgtctcataaatcttccacacttctcctcttttctaaaacttttaactgggctccctggaaccagtgtgcaaaaaaaaacaaattatccttttcctttctaaatgattgccacttttgctaataacacttctgaaaagaggcagctcactctctcaatccttacaactgctatagttttaagggcaatctcttggccttccatcaaaattaccatttgtccagctacaaagctggacttgaggttcatgaaatctttacacttgaggttcatgaaatctaatagttctcctctacccttattcattactgtcaagtaataactatttttaaaactctgcaactatcctggatggttttaaggataatatccaataagtcattctcagagttcccttactttctaacatctaatgaacttcccctgcacatcagttgagccacccagattcatggctgcatattggatcttaccatcatctgaaaataatctattttgaaatcacatcaaatcctaatgttctactctctgctacagttttctctcctggttgcctaattttctttctctgttggtgtctcttgactattcacattgcagtctcctagtgatactctcatatctcttctgctccctgctttacatttcttttacaccacactgctagcaaagctgtctttctacaacacaaagttaatcatttaagctcatatttatattggataaagccgatctccttgacaagacaggccaggaagccattatcttggaccttgtattttctccctctccagcctcacccttacacatgccctttaaaaaatattttggagtttcatgatcacactatgtactctcttgtcactgagactatttatataaacatcactttacattttccttcaaaatacctatttatgctcagacatcatttctttaagaaaaagtttaatttactgttttcccttgggatggattaagattcccacctctagagcccctgtaagtgagtatgtatcacaccctaatatttaacctctttggatgcttcatctaatttactctgaattgcaggaaagaagacaactgctcttatctggatttttagctccattgtctttagtaaaaattaaggggaagaaaaaggaagaaaagaaagaaggaaggaaagaaggcaggaagaaaagaggaaagagaggaaaaataaacagtagaaagcgagcactgcagatattgtgtataaaaataatgcaatgatcttaaaggtacctttaagaaataaaaataacaattcatataaaacaatggttacttatgtatcatacaacttcaactttaaataatcagcatattaacactatgtcattcataattccaatttatcaatataaaatattgatattgatatgaaaaaaaggctaggtaattaacccctttgttagagaattaagaaccttgctcttcaagatcgatcgtgttcttggcaagagcatggatggagctaaaggccattttccttaggaaactaatgtaggaacagaaaaccaaataccacatgttctcacttataaatgagagctcgatgatgagaacacatggacagatagagggcaacaacgacagagggtggagggtgggaggaggaagaggatgaggaaaaataagtaatgcatagtaggcttagtacctgggtgatgaaataatctgtacaacaagcccccgtgacacaagcttacctatataataaacctgtacatggacccttgaacctaaaagttaaattaaaataaggaatattgtttctaaattataacacaaaatgtgtacatacagaaaacaaaactaaatcatggaggtgaatacaacagaaatgatttttgtgataatctgcttgattttactcttcaaagtttaaaatgtgattttctcatgagatatctcaagtcttcttttgttgatggtggcagaattaattgaataaaagcccctccaaaactgaaaaataattacataaatatgtgcactcttaaagagccactttacctcatcataaaaattatataaaacttagaatgaatgtaaaactaaaatataattctagagaaattgatcagatttgtagcctcctatatgagattactctaaaatcaaagggattctataggcctattttatcgatttctgtgacctcacaaatttatgtactacccaaaataatttcaaaagtatggacttaagccattgcagagaaacagaagagaaatttatgaatagaatagtgataaaggtatatataaacacataaaaataaacaacttatattccaacatcatagttcaatgttagtataaatttaattataagcttcttaagtaccaaaaataaaagcatgatggcaacgacacatgaagtctaagagataacatcatgataaacagaactgagaagaacttttgtcaggtaatgaaggacatttccaacatatctttttttgttaaaatagggagttttatatgattaatttttaaaactccctttcaatgcaggctgatgacataattgctgaagcccaatttaatttaagagaaactgagaagggctaaaacaacatagactacatctgtcttgagttaggggtaaattagaacatagaagagtgagtggcttgcatatggcctcattaggccatattccatatgagattattaaaatttatttgcaatgtcactttgttttggattggccagctgagatttcagtgtgttatctgcagcaagaaccaagaatgcattttttaatagattctattaaaggcagaacatctgttttgacaatcagttgggaagggttaatggccttttataaattaagcagcttatcatgagtctcgatgagttgggattcatcctacatttttttggaagtaaaataaggggaggatttaaggaaatctacctttgtaaacagtttctgacctctcttcaatatggcagtaaatgaactatagctataattgttaccagaacattttttttcttaaaaaaaagcattctaagtacctaaacacagtcatgggaaaatcttgactaaatcacacattaaataaattttaagtaatatagatttttgatagtactttcaaaagatactggatgccaattgcaacctcagaaaactaattatatctgatgtagggaatcattgtttaatttttatttgaatgaaaacaccatatgataataattttaatttcagagtagttgattttaacccatttttatggcaacagccattatcaaggccaattatctgtgaaagccgtttgtaatgcatgcttataaaaagcatttcatcagtgcagaggagatgcttaccttgctaatctctggaaatggtgagcatatatctactgaatcattaacctacagcttataacaacgattggggaggaatgggaaggctgagaagggtggtacaaattttttttaatgaccctggagaaggtgttctaaaatatgagaagacaatggctatggatcttgaccttgtggtatgtcattaagatacaaggctatgtgagcttcaaccagaaattaaggatccacgctgtatttatagaggtcattcaataaccaattcctaactacagagtcaacgactaaggaaaaaataaaactagacatcttaagttctctaatattttttataatgtgatagagataatatcaatatccactttgtattaactgagtctgaacctcatctgctcctcttagagaagattagccaaagaaactggggcatacaatttcttaaagaggaaactggtactaaataataaaaaccaaaacaacatgatatatgtgaggactaacgatttgctttaaatgaagggctacaggtcatgcagtgtgaaattattcctggaaagttactgaaagttcgcagactgaaaaggctcagagcctatcagctggagctgattaagcaattttgtgggcagaacagtttcattaatttgtttgaagtatgatcacttaaatagttaatgtgtacaacagtcaatatttttattccgtgacaagaaagtaaccttttaattcggacttagctaggtgggcaaaattttaaagcaaagtgatttaaattgatttattaacacatacgagacccgaagggcttgacacaacaagtgcacttaaagaattacaagcagttcaattatccttgatttctagtggataaggtactatatgagagaatgagtaggttgatccagttaaagacccttgtttactgtaatagagtgtttgggattcaaatagggaatcaccaaaaatattttaagagtgagagggacttataatatttgcattttttgaaagttgacccaggaagcaggttggggtgtacagaaaggaggtagttcacaaggatgctactgggacaatcctagaataaaatttgtgaggctggtatacaagacagtcacagttgggctgaagtaaagagacaggattaagaacattagaatagaattgagtaatattatattccagatgagaaataaaaaatgctacttaggtttctagtttgggaaagttggggtgtgaaggtttcagtagctgagatacaacagataaaatctctctattgggatttggagaaaatctcagagcacagctctggagtgataaccactcgggctccacttctaaattgccatgtactattcatgggacactgggaaatttacttaacctctttgtttctcagtttcctcatatgtaaaatgggaacaattataatatttatcttatgttgtcactttgaaaacaaaatgaatttatatattgtgttacttataaccataccccttcataatctcaattcctacctcactcactctcaacctgacaccatttaccttgattccaacaacctttgacttcactgtaatttacaatgtactatttctaaaatctattactgtacctcatatttaatgttcttacttccctcacttccagctcaaattccacgattaagccttacaattactcctttgcatatattctcaactctctggctgccctctctgtacatcacatttgccaaaagacacggtcacatgaagactgggctgtgcctattccattcataaagctggaatgtaactagataaatatgactgaatgtgagtaaagaaatatattcatccaagccgactggaattatatactaaatggatgattattaactagaggtagctgctcttttctccttgaaaatcacagtttctttgaacaattttgttcccactttcctaggtgacacaggcttcttacacatcttgcaccatcctcactctagctaatgacccaggtttctatttctttgagaaaacagaagtattatatctttttgccattgttgcccctcaacactacacagattgttccttttaaaatataagtcagataatttctggttctggtcggaatcctctaatggcttcctattttattcagagtaaaggccaaagattttacaacgacctaaattgtcccacccaatataaaaatcgtatgatatctttgaacttctatttttcctcctatacactcagggctagccactaatccccccagtgcctttgagatctgtcaagtgtctactgcctcagaatctgttggtgaagttctgtccccagatagccacagaggtgactccctcaaatcactcaactctactcaactgtctcttcagtgaacatcttgacagcctcttttatcactgcagccccaacatttcttctttctctgctttaatttttcccttgacattgaaaacaaaaccagtacttatttattgtgtatatttaaggcatatgattactgtacaattaatgttttgatattgttaaacaaaaattatcaaagtccattgttttggactgagctcctacaggaggccccaacagaccagaccagaccaaaccaaaatggaaaccaaactttagtacaaacaacttgtactaaagtgtcacataatcaagctgaaattttaaggaagcaaactgaatcccagaacacatcagttgtttctaaaaatgtgaaattcaagtctacctgacttgggataataaggatgtaacctctcctttaactctttacccaaagagtaacctgaagtaacatgatgttaaacaatcagcttttgttttgtattattgtgttttcttgttcccaccttacaaaatccactgttctatgtctagtgggagctctcattctactctgtagaatagatgctgtcctaattcatgaataaaggcctatttgatctataaataaatgtgttgttattttgttttcaatagtgtaaatattcatagtgaaataattattatagttaagcaaattaacataaccatctcctcacatctcctcatatagttacccttgtgtgtgtgcatgtgtgtgtgtgtatgtgtgttaagagcacctagtctcttggcagattttcagtatgttatactatatatatatatatatacacacacacatttttttttgagacagagtctcactctgtcactcagtctggagtgcagtgatgcaatcttggctcactgcaacctccgcctccagggttcaagcgattcccctgcctcagcctcctcagtagctgggattacaggtgcctgccaccacgtacagctaaatttttgtatgtttagttgagatggggtttcaccatgttggccagggggggtcttgaactcctgacctcaagtgatccacccacctcgaccccccaaaatgcagggattacaggcgtgagccaccatgcccagccatgttgtacaatattagctatagtcatcatactgtacattggatttctacaattattcatcttatgtaactgcaactttgtactctttgaccaacatctccccactcctcccctcttcatatcttcagggatcaacattctactctgtttatgtattttagtacaaccaggtactaaataatttatttagttttattgtttattgtctacattacccctgctggaatgtaaactccataaaagcaaagatttgtctttgttttaatgttttctttcctacctataatactgtttggcacatactaggcatgcaatgaatatttactgaataaattaaataatattttagcatagtctctgggatagcatatatgctcaatcaaaagagctataattattgcagtagtaaataataatatatcgggtatatgcacttaaaataatatgggtcctgcaggtggcagttctaggtttggaatttaggataatgagctgaacataaattaacatggtaatgcaatcaactgaataaacaagatctcattgagaagaatactaagagaggaatgccatgacataggagggtagaatccagggatgcaccgacatgggcatgtcgacattgtgaacccaggaaagatactgaaagcaagtatccagagaaacagagaaaggaccaggagtgaggtataatggaagtcaatgaaaggtagacattttggaaggacgaaatgctcaatagtcatcacacgcttcagagtagatagtaccacaaaaatggtaaacaacaaatgctgagatataaattattaaaactgtggggatatttaatgattagagatgaatcttcagaataaaaactgtctaaaaacagcaatgaaagatttttcaagattgttcaaagacaagaaaattcacgtaacacacgctctttacatttgattctctcaaaaaaagaagtgatagcataataaaaagaatacaccttatgtttgaatttatataactagaggttgacataagtgggccaaggaggcagaccccaggctcactgaattgagtggggtcttgcacagacagatgggtagtaggaagaaatcatagatctcatcttagagttaaaatctgagatcaaaaatgcatctaaaccagtaaaattgccatatttcaaaataagaatataaataatacaaaaattctagaagtcttcaagacaacacttaaatgaataaaaacaacatttaaattaacctaaaatgtaaagtatttttatatggctctcattttatttaattaatcttatttaccataggatgtctaataaaccttacatgaagaaaggaaatttagaattagttattgctatactcagcaatatggaggtattttcttttcctctatttttgtagtttgagaaaatgaagcatttttaataattttgtgaaataaaggcatttaaaatacaaccagtattttacagataattagaatcataagtggtacaaaatgagtaatatgattaatttctaggttgacctttagaaaagtatttttctatcatttcttagttgttataattttattatatcaaatggaagttccagccatttaatttccatgttgtttttcaaaatgagaagtgcatcatggatataaaatagtttgttttttaaaataactttaattttcaaagtaatttgggttttgaatatgaatattgtttgaatatctgcttctcttcctaccaaggttcgttcttttcatagttactttactcatgcattttcatttctatacttattgaattaagtaattattttgcaggtagttaaatttattgttcaataaaattttttttttaaaaaacagctaatagcagtgcataactttcttcatggatgtgtcatcattttaggtagcctctaacctagatgagagccctcaacattgcagatatataatgtgcatctccagcaaaattgcccataagaataacttcattattctgggaagctagatctataaaatatataaaatgttgaagtcttctgcctttacaattcctggtaagtagcagcacgactaagtgataaaacctgagtcagcgtcatttcaagcatatcgttctagaaagcgtattttgacagaaggaaaaaggaaatatagtggacaaaggtgttctgtttcagagtaacgacgtattttagatctatatacttctaccttgattgatgaaaaattatctctagaagcttttaatggtatacgatactgataagtcacagcaatcctaagttatagtagaatgataaggaaaaactcaccagtaccactggacagattgttgtgggtggtaaaatatggtccttcaaaggtccacagtcacattcaggttttagatgagaagcacatttattatgcagctagaaaaacagaaagggggatagtatcaaattctacatgacaacgcctaacatgggggagattatatttcaatcgagatacagcaaacacattaaaagtacaataaagaaattataagaacaaataaacagagtcataaaggaattcataatacatttgtccttatatatgaaccctaaataaaccatctagcagcttctgtgacccattctatacattttataattctcagaaatgtttatattaaaaatgtactttaggttttacaccaaagaaccctgatttctttgacaaacacaaattattgtccattacagttcttcctttgcttatctgttagcataatcttgaaaccactgtgcctgtgtatgctttttttttttttttttgaccctcctgttttctcaaagtcattccaaagtgcacagctcagtatggggcataattgatcccatcattagttttaactttgtaattcaatatgtaaatgtaaccagagattcatctcagtaggagcaggatataaataaaagaagatgattatgattataaaaatttatctgtatattgtatttatcagctcaacgttaagttagtatataatcatacaatgtcctatttattttttaatatgtatgagcccaaactaatatttttattaacctggtcataagtttacattaaggtgttacaacgtggtgttttaaatagtgatgttttaaaactgagatggtagttttttaaagaattacacagatttggtaaaataatacttgcttgagggcatctagagatttctccctcctgcactatgcattaatttgatatgaactcttcatactttagaaaaaaatatacatttcaataagataacatgttatgttcaaaacaaaaaagagccacattatttttccattttgaatcaaaagctacctcatttaagccttggctgcattaatttccacaacatacatacctttgtgagcagttaattatcaactaagcataggagtctaatgagagttgatttatttttagtaatagaacagtatcaaagaggtatttctgcggtcctagaatctaacactgctgtcatgctaactccctgcattggagttaagatgacttgtactgtaattaatgcccattaggttacattacatgaaataaacgtatctttccatgttcatccataattagcagctctgcttctcaggggcatataaacttctctataaaaaagtgatttaattgtattaggcactactggtctttgtcaagaggcaagaagtgttgaagatagagaagcagctgaatgcacaatagaactaaataaactgatactcagagcaaattaaaaggtatagtttcctcaaaataaaattagtgacttgtttaaaatgtattattaatttattggacctagtaattaactttcttagaatctgccatggccatggatgtttggatttagagttaacagattagcaagtgttgggatggatcaatttctcccaaaagatatgctgaagtcctaacttctgggacctttgaatgtgaacttaattggaaatacggtctttctagatgtatttaagctaagatgttggtttagctggaccctaatccaatgactggtgtccttataagaagaggggaatctggacagagagacaacggcacagagaggagaagtccctctgataacataggtcgatatctgagtgatgcactacaagacaaagaattccagggattgctggcaaccaccagaagctaggaagaagcagaaaaggattcttccagaaagccttcagagggaggatgacctgctgacatttggaattctagcctccagagctatgagtgaatacattcttgttgttttaggcacctattatatgacattttgttacagcagccctaggaaactaataaacccagtactatgaaaacggcactaaaaccaaagagagattatgggtcttaagactctgctgcactatggatgtcacagagaaagagctttggctctttaatcttgggcaacttccttaaaactgagaaaacagacgctaagaaccctctacaaaaaacagatctgagataaaaacctatttgtgtttacagcaagaaagtgttgaaatattattcttgattacagtgtaaagctaaacacgtgactctgaaggccacaggggcaggacatactgagtcttatgccaacgctgactacagatgcagtcagaggcctcagcctcctccacacctccatccatgtgtttccaacaatttgcaactgacatggtaaaggacgactaagctctctgtatagttatttgagggttactgatgtaagaaaggatgacaaaaataaaattaatttgatgatagtttgggggcatttaggctagtttcccagaaggaaggaaagaatcgaagactcagatagaatcatgcaatagatgagcttaccagagtgtgtgtgaaggggcaactctgtatattgggatttgggagtttcagagcataggtactgacagttgattccatgaaattctggtctttgcagagccaaataaatctagtatgggatttcccagtttgattgccgctgtggtcctgagttttgtctaggcggtcgtaaggcactccccaagacataggaggatctataagtttagtaaccatactatcatctgttaaacagagtcacacaatgcaagaaaattctcctaaccaagaagtctatatttgataatatgcaggaataccttatgcttgtattaagactagaatctggcagctaataaatacattttcttaaccatcaacattatgacgttgtttgtagccaagagtgttaaaactgagggcatcatgttaggagtacggatcattttacaagtcgtgaatcaaatttgtatgacaggtttagtttatgcatcatatttcttggagatatacttgaggaaaaaatatacaatgtgaaagccaatgtgaaaaatgtgtatcattttcaggaccacctataaagtgtaaaagtgaatatcatctttgctgtgaacttaaaattgctctaaatcataaagtctattttaaaaagcaaaaatcaacaaaattatacaatagaattcaaaagctacaaattttttttctttaagatactggtaatattttgtttcctgatcaggtactgcttacagaacattcatgtggggaaaattcattgggctctgccctttggatataaatgcctttctgtatgtacactttccttcaatgaaaagctttttatagtttgaaagaatgaataagacctactatgtgatagcacaacagggtgactacagtcagtaataatttaattgtacattttaaaacaactaaaagaaggtaattggattgtttgcaactcaaaggataaatgcttgaaaggatggataccccattctccatgatgtgcttatttcacattgcatgcctgtatcaaaacatctcatgtgcctcataaatgtatatacctactaagtacccacaaaattaaaaataaaaaaattaaataagtgaatatcatcaacaatagaaagttgcttaaacttatcatcatatttcgtggacaagaatataagaaaaagacacagctgggtccttctcagtgtaaataagatgctgaaggctgactattgttttaaagataacctatatcccaaatcagcaaaatcctaaacaccagggtcctcatcaagaatagaaatgaactacagcattgaagatgctgcctctttagtaaaataaccaatagcgcaccagagaaaatcaaatgtttactatttaaaatttaaaaaaacatttttgttcagttatctttgtatttttttcaagccaaggcatagaaatccttagctcatttttaaatatacatccagaaattcccattcatgttaagggattcagtgccatatgtaggaaaatcatataatagaaaccagcttttcctggaagtgaattaaacacttggaaataatttcagagtttatgacaacttccagtagcacctaatttagagccagatctatgtttattagaaaaagctgtctcaagatagaaagaaaaagaaagtgtgtggatgtctgtgtgcatgtgtgccagcatatagttctatggatggagttaggaagagtggctgcgctggtcagagaagaaaatgggatctgagaagtcaaaaggaggaaaaatggaaaataagtgttcataggaatttagaggaaaataagaagagaaataagctacttttctaaagaaaaatttgaagacctgatttggaggcacatatttactggttcacctgttacactggcccctaatattttgcagtttggggtacttcctaagactggcatttactgaagcagaaatgtttccatggcattggaaacctttaaacattactgttaggaatttagtatcttaataaacaatattatctctatatcatagcaaaagttagtaattcatttttatgaaataggtgttattttttcaagcctaaataaaatccctcaacttcccatcctggtgagtcctgcctgaccagtgagagcttaccttgacaagcaatgattcacaacatgttatacaacgaaggtcaagaaaacacagtttcagaagaaatgaacaggtataagcagtgggatattaaggatgttagtaatcaagacagaaaagagaactgaggtgaatattttgcctgtcacagaggattgaaatataaaacacagagactggttgcctaattatcagaaggcagttttccactgatctttcctaagcttttcgtatttttaattttgaagtggctagatttacaaatgaacagaaaatttcattctaagagcctaactttatatctacaagatagccaactagtaaatcaagaaactgcaagtatgaactgaaaaatgggtgtgaaaattgattcttaagtatttgtttaagtttacttgcatatctgatggagatttgagtattacaggatgatattataaaacaaaacttaaatagtacatatgtttgaaatttaatattctactgtaagaatagcatatcagagattaaagtgatcttactgaagacttttctacactcagtactttgtcaagaacttcaggtgattaggaaaaaatgtgtgacatggacaagcaacaggagcgggccacagttaacagtgcaaacgatgttagactatggtgtgaaaccaatggagagcatttgagtttttcctttggatgtggaatgtaagtacagaaactattcagaatcaagatatattagcgtcaagaaaaatttcaaggaagacaggtaacctaacttgtttcctaaggtatgattagaatttaagacaggtgcattcaagggaccgggatgaacaaaatagtaggcatgagggaaacatggcctccccaagggactgccaacagaaatacacagctatggcagagggtgtgtgtagaagaggaatattatatacagttatgtttaggtttgattctgatttctaaagaactaaaaaccaacttgatgcaaggggtgttgagggctgcatttattatcacagaactattatagattgctaaagaaggcatataacaaactagtattttcagaagatctttctggaggtggtatgcagcctgcattataggaaaagtaccttctgttagggagatgagccaagagattttgactctaatctagtcaagaggtgctaagagcttgcactagggctgcgaatgtggagacaaaacctcaaatctgagagagatattttaagtaggaaatgacaagactcagtgacaggttgtgtacaagagataaaggtaaaagacaagagtaaaaaaaattgacttcaaactttttttccagtgactggaagcatgacaataccaggtctgatagaatgagagagttgtagtaacagtctttgggaataaaaatcagtcagttgggcttaggatttagtgagattcaggaccacaggattctggatgtttttttgagtgcatgcaggtgctgttctgactcagactggacaactatccatccttctacaggagagagagaaatgacgtaagtgttcttcatggagtgccctctggaaaaccagggattggtttatgtgcacccaaatgtatttatgtatttcataatacccacaaatataattgttacttactaagcacttaatatgtatgaggtcttgtcctaaacatatctacagagaattttttgcccctttaatcctcataataatctaataacttaggtatcattaactccatttgacacattaggaaatttgtctaaactggttacataaatggcccaagatggcacaactagtaagtgaggagacgatcttaagaatctggttggtctgagttgcaacagtcaaatcatttccaaaagtcatatataaaaggaagtaatggcttttggacaaaccctgaaagaaagccaagcatcattctttctgtttctctctacaatatattcttcacggaacccgaatttcagataggcctttctgaagccagcactggcagtgccatatcccattactcccataacttctgctagctctttgttatgtccatagtactttctggaaagtgtaagagcaaaagaaagtacattcagttgtttaaaggcaagcagtagtagtagatactcatcagtcaagagcagatcaattttatgctgaaattttcatgcaatggttcaatagaaaactataaatactactaaatacataaatgttctgaggtaaatatatcctgtttaaccaaggcacaaaatcaataattaagtaaatgtgtccctaaaattgcttaaaattaaaaatccggaactggatggaggctgaagtgacttttgagaaactgatagagtctcctggatatatgataactttttaaaaatttgcacaagttgtgttttatgaacttaatacccataagacccctaaagctcattgtttatagaaaataaggctgaggatggataaaagtctcaggactttagagagtttagtaagagggcagcctttttttttctttctgactctgccttaactccaccagagatccctggttagccttgtttcctaaatagagctttgagattgattaattgacttatttattaataattttgaacttggggatttaagacatttgctgtttatgttgtgctttgccataatgacaaacaaaatcacattcagctattcaatggtatttagtgtaagaataaaatgttaagggtatattgtcttatctgatttgagacatatgatatttagatttttaaaagtacagtctattgaaaagtgatatcctttttcctgtaaaagaaactgcctcttttcctgtaaggctagggtcaggatcaagaccaaagaaaaatgaataacttgtgaatggtagggctaggtgtggattctgaagtaccagataagaagaaccattaaaacaaaaaggaaaacaatgagaaaaacaaaaagcaaaaccatgaggaaaacaaaatggaatataatacaaggaaaggaagaattttaagatgctttgtgtaccagtaagagaccactagcaatggtaactttgaggacagtggttctcatgactggaaagggtagaagacagacttcatggagattaaatagagaaagaatgagaggattcaaatacagaaaattctaacagctttgaaagcttttccattagaaaaggcagcaatgcatgtttttagagggttcaaactgagtacacacttaaaaacattgattttttaagaactaaaaaagaaaatatgaataataaacctaagacaataagtttgtaatttatgaagaataggtaaacaattggagatacaaagaagaaattatttctaatattatctaatctcagcttatgttaaagttaagatataaccagtgaaatattcactatatgaaaaaaataagaggaagctccctgcaaggtctgaaacaaaaatgacatatgtttgtaaatgcttagcaaaaaaaaaaactggtttttaaaaatctacatgaatgtttttaaaaatgaagtagttatgatcttcttaaaactgggaattcaatgtttgagtaattcatgtgtaaaatttgaatcatcgttagacattttattatactaaccaaacacttttaaaaaactatctttcataatgagaaaatttcaaatgtaaacataatttaactaatagctgaaaatgattgcagaaaatgtattcatttaaaggaaagtacttaattgtatttttgaaaagtaagtcagttgtttttctcatcattctgtatgagtgtgcatgtgtgtgtgagtgtgtgtgtatgtgtgtgtgtgagagagagagaaaaagagagcatttaagagaattgtttaagccctgggttgagggtggggcacttggggacacagtggagacagttatttacttaactgattcagtgcctcctactgttttattttgacaaaagtaaaaactttagtcctgtaacacgaatactcactctaagctgggaaacaaaacctcagccccataaatattttgtactacattatcaaaaatagctattattgaaaatgtgtgattctaattaacttacagaaattacacatataactgtagaagtaccatctaacaactgcattcattccaaaaattttttcaagctagatttgacagtcattcaaaccaggtgaaattcccaagtgtcccagaaaagaccaatttatctcttcttacttaattgtgaacaccatcaagacaagcatttacatcagtctctcttataccccaatgcatgatttaactgaaagaggaaggcaacaatatgttggaagaagcgtaagatgaatttttagatgcatcaagacctgaataaaacacggtctacttgcccttctatctagtcacgtggtcaaggacaatctgcttaacttttttggtcttagtcttcactatgtacttaaatcattgaagctcattgttcatttttctaacccttttaagcccatagattttatgactaaaataagtttacaataagcaaaccagaaaacccttattaaacagggttgtggagtaaagggagagctgagttctacccaaacagtatcctattcttattgcttactcctagccatggcctctgattaccttcctgggaacctctaacactccatggaacacagtttaaaaaccataccatggtatcatctcttagattgtcaccagctctaaaattcaggactctatggggacaaatctgaccctgagcctatctctttgcaaacaagctgaaatgagaagtttccatggttttatgcttacactcagtttcaggaagcccttctagggtaggactttcagagagtatgatatacacgtcttcagtgtgggtgaatgctgggatttgttttccaatttttactcactgtgatctgacaccaaacacaatgcagtcctgtcaggccctggtaacatttaacagttttgtggcacttatcacacttggttgggcagttaccttcaacccagtaatggtgcatgacctagaacagaatgacaacattgtgataagaggacacactacataatggccaccttcagaaagcaagcatgcacacaaacttacatcagtgttccttttggacttcacataggtcttgatgcaagagggaggtgctcgagccacacagcgctcatggactgtgtacttgcagactgaaaggaaacaggtacacaaattcagagctaatcctggtcctggttgtaattttatagagaaagaatgacattaacagaacctcatttcatatccactgctccctaatcaatccaatcagccacatcaaggagaagtccaagtcgactgtttttaccatggaatataaaaggccaattagtacaggaaatattatgcatgtgaaaaaccaaggctcctctatcatggcatagcaggaaatgcttaattaaatcagtcctcactcaaatttttcacaataattcccagatgacaaaaatattaaagacaaattgatgactgccaaatggcttggtgtcatttgctagaaggaagagatctatattttacaaagtataggcatgagagcagctggcgggtatgggaataaaagcccatgagtttatgttattttgtctcttatctaaatcttaaatggctgattagtctatttccagagaagagatttcatcatacatgccaggcctttggtgaaaattcatccttcacttgccatcatggcatcgtttgtccaaaagcaacagcctttgctgggcggcatattgtatacatatggaaaaatttatgtcactatgcaaatgtatacctacacataagcaaatatatgtatctatgtatatatataatacgtgtcagaaaaccaagacatacatttttggcatcttcaaattctttatggtttgagtctgaatatgatttagggtcaactacatgtgttcttttaataaaatgttggttccagattaagggttctaaatgcataaatatataaaacagtacttaaaaataaacatatagcctcctcaataaaaacaaaagcaaaaaactaaccactgcctcaaattaaaatgaaaaacactaaatctaaataatatttatatagtaaaactctcccaaaatattcatatctgtgattttctttggcaacattgagggagaaaacatgttttctcttctcctccgtattaaaaataatattgaatattgcattcaccacactaatcagtaaaaacttatgagcaaaattctcattcctcatataatatcactcatcttatttgagacttatcattttgttttatgtgttcttgttaacagactgtaccataaaaattccttttcttaaatataatagaactttaaaaacaaagtacttcctttgtatagggagaatgttctagtgtaactaacatgtaactaaactttcaaacgtagctgtcagagactatgttacacatggcaaatttcaggtaactttattaaaattcgtaaatagttcagaaatcatatgcatatgtggcattaaaacatggtattaaatttcaagtaacacagctgagagaaaggaaattctcaaacatattaccaaagaagctgctagctaacgacaaacaaacaaacaaacaaaaaacctataaaccatggatggtattggaagccagtaagaaattagatttaatgaaatgcacaacaatggaatgtatctaatgaacttgacagtttcagtaattctgtacaagctgaaaaggttggggagagataaattgatggattaatggagaacttaaatgaaggggttataatatctacccttttttatcaggactatcatggattgtaaaattttctcaggtagatatgctgtagatttaaaattacttaggtgattttataaactaactgttatatacactataagaacattctaattggcagacctgagttaacagaataaaatgaaaattgcaaagatgggtgaactgaaatttttaaaatggccacgactcattaatcatcaatgctctgcattccaatgtctattaaccatatatgaagattttctttctgttagcattgaaaataataggcttgaggtgtaaaattagttcgtatatcttgcgatttcctaattttaatgcaaatctatttttaatcaattaatgtaacttaaacaaaatacccaaaggaatcaactcattataagatgttcatgtgaataaagtcactaacatgtggggagggggggatgaatatgaataagatgtaagtatgaaaaactagtggaaatattcaaaataatccctgaagaaatgggaaacatgaataaattaaactacagtggaaagaaaattgctgaagacttggaaaatgtccttcatttttttccaacggtaggtttttccaaaactgaagaaattagagtaacctaaatattcaaaaacacactacaggaaaatataaatcacatgtacagagacagtccagatcagatcttaggtctccatttacaaataagactattccatgaaatcaacctttcctcacttgaggagatgatgtccaggcagagcaaatgtactcacaggaacagcagaggccctgcttccccacgccaatcagcatgttcaggcaaaggttgcaataggcaggtttgttaaagtgcttcagtcgccacacgtgctgtccatcatccttcacgttctgcatgggacgtaagagaaacagatttcacttaatgaaataaacagtgaaagatgtaagtgccaatgaaattcagagctggactgaagcatgtgaagacaatctgttatttcatccctgactttctccaagatcaccgcagagcctttagaaaaacacatgtgctccagtgaaatgagatagtgctaacaaatcaccgatgctatagcaacccacaaatccttgtctaatattaacagctcaacagcgtaccccaagccatcgtcatgacctgccaaatggatcagggacgtgattgcctcttctttaaatactttatccttagcacaattccataaacaaataaataaataaagagaaagagaaaatacccttcagtggaacagcctgacaaagaaaaacctgcaaagacgtcattaacccttgcttactagtagtaatatacaaaattcatgatggtgatcaggtcatgtaaggtggcagaggaatgggatgggatggaaaactaatactaaaaggtaagttattggtgacatactagggcttcattcgaggagtccttatactatattccaatttatattaatacattgagtatgccacaaatagtatattttaaaaggcaaactttttaaaggatttcattatgttaccattttgtttacccccttataaaatataagtagttttaatctcacagaaagatggtaaaaatattaaaactgtattaatatttttatttataacaatcactatggttatttgccacaatacaaccttgggtttaaattaattcccactttagcaaaacactttatttttttctcttctcagtaaaactctctatatcataatagctactcctgtaggtatttaatcacagctgcattgttcaagattaaaataaaatgaaataatatgatgcttaggaatttcttgaactccttacaagaaggtcaagatattaaatgaaattattatatattattacttttgctaccatcattttctccattaacatgtactgtttgtagtctaatcatcaaattatatcaaacagattaacatttattggtattctattgaaaacattatttgccataactttccaggttgtccaagttgtcatatttcttggaacacattcacctaataatttctgagcatgttttaagtgcttgggcattaacgttactcctgtggtagtgaggcaatataaatatattcagatcatcttgtttctcttgataataaaatattaataataatgctcctaactacctttcctattcccagtcaagggataaaccaccagatttgtaatactagagaaaatctacagtaactaattcttacattagaaccagaaatgtcaaatttgcctcacaacatgaaacattaatgaaatgcttcctgggcgataattcttggtgggtctcttgaatttcttcatgttttgcaaacagaagcactgtcctttctttttctttctttcttttttttcttcttaagactatcttttcaaagatgtttgagtaacaaacagcctagccttggacaatagagacatgtctccctccagaggagagggccagtttgcttactatacttacagtataataaaaataatcactcccttgtaggcaaaggtgaaatgggcttgtttcctacacattataattcatttagttttcttaagtcagggtttccaaaacgtgatgctgtgcacaatcatcaattgggtcccactctgtcgttcccatgagattttggaggcaaggtgaactcaaacgtgaagctcctgttgctctctttgttgtgaataacaaagtctattgtctctgactcaggagtctcatgtcctctggcagcatccataaaactgtggcaagctaatacattaacttccaatagggtaaattttggaccctttacaattcttgacattgctcagatttacctttctgacaaggggctaacaaagtctcaacaaatacagctacgcaggtgtcatacagaaaacttcagaaaacacaggtgttttaattttctttcaaaacctaagaaataggctttgtattaatttctgaatttcctattttggtttcggtgagtcatagatttctagtagctttatcacgtgaatagaatactttatatatttaactttgctatattttcaaaactgcctacattttaaaatttatatcccctcaaataatatttaaacatccttatgtggaaaggttaaatatggggttgttaatttttaaaaaactaaattaatatttaaaaaattaaaagtagtagctaagtgcttaaaaacatttttaaataaaaaggacaaaaagctaattttcgtatatattactgttcttgtaattcttgtcgttttatttttaaatgattgtccattacatgtgaataagcttcatcctttgaagagcacatatggagtaagttagctggcattttccttatcaaaaaataaacaagtctgaacgtgggtgttctgtcaatcagaacacttagccgtgttacaggctgcaactgatgtacaaatccattacccaggcataaaatgctttaccaaaaaacaaattaaatggctttatagctcttagctggatacattgccaaaatatgcaagggatgaaatatgtatgtgacttctttaagagaagaaattgaaaccaggagccaattacttctcagcagtgcaaattatactccaactctctattttcatgtcttgtcttgtttatcttacttagatcgtaaacttaatgggggagggaaagaatctgtcccttctttctatcagccagtagagcacattcctattagtccttccactgcaaatatatatttattgtcaaaaaagggaatttattttttataaaacaaaaataagcagggcatccagaaaggcttgattcctagcctactatgaaaatgtgaataagccatttcacctttcttcctatttcttcctattttcctctcgaatgaaaggaaaatacccacttcccttttccaggccgtggtgtgaggtttcattatacaacacctgtgaagttaatttggtttctcagaagacgggtgttatataaacagcaaatattatcaccctcattgggttgtgttgtgtaacatcccaatttttcagtcaaaataattgagaaagatacctaaaatttcactttatttcattaaaatgtgctcttttttcatcaccagacataacactgtgtattgtaatgaagctgttcaggtccgtgtttatgacagataaatgcttaatgaatcctaggctactccatgctgagaaggaactttacattttccccaactcttagttgcctacaaggcaaagggatgtttcaaaggaaataatgctcttcagaacttttaaaacctattatcctagtgattctaaagttttagtttttccataaataaaaatcattatcctagtgattctaaagttttagtttttccataaataaaaatctttatcctagtgattctaaagttttagtttttccataaatacttccaagatcacataaaatgttcaagtgaactagggctactataaataattttttttcagaagacctcaaggagaaatttcattgatgtcctaacccacatgcttctctccccacacctagttatgtttcaactgacttaacttatatagagagagagaggagctaatgttacaaataattacttccaactcattaaataacaaagaacattaaattaccttactttttgtccaaggtctccaaaaaaaaaattatgacaatgtgacagaaactcctcttatttttttttttttttttttttttttgagaggagtctcgctctgtcgcccaggctggagggcagtggcgcgatctcggctcactgcaagctccgcctcccgggttcgtgccattctcctgccttcacccactgcgcccggctaattttttgtatttttagtagagacggggtttcaccgtgttagccaggatggtatcacctgacctcgtgatccgcccgcctcggcctcccaaagtgctgggattacaggcgtgagccaccgcgcccggccgaaacttctcttttagacaaaaagatgagctctattaggcctgggcaaagagaatgcagagaaaagttttaaaattctgagtggagctgtcatcaactgttcatctccagaccacacattgtaaggtcacctgtcattcctgaggctcaaatgcaaaatcaacagcaggttacaccacgtagtcatttttcttaaatgacacaatctggaatctcaagaatttttgcattcatctagttttgtaactgctttctacattgagcaaagtatagacagcagaacaaaaactcttaaccaaattaaaaacttttaaaaatcgatgtgctgaacatcagctcccaaaatataatacatagtcttctattctccatcactcaggaatttcatcagagaacacactgcatattactttactgagagtcaagaaaaaaatgtgtcttaaacaatctcagtcaaaggcaaagtttaaatgacctataagaattgaagaccaggatttttggcacacatatagtgagaccaaagtataaaccatccagaaaccatgcaggctagatgtgggtacaacaatccacaataacaagttaaggtatcgctatttcaagctagtctactgcttaaatgtacatttctcttttccctataatataaattcaggaattttccttgaaaaaattaaatgacgatccaaagttagagatttcagaaattgaagccttattaattatcttgttcatgcaggaaaaggaaatgttcaaactgaaagagtattaggaaacactaacttctcttcttggctaacttctcgtttttccggagacagcaactgcctggtataaaaatgacctagttagttaataacagagctaaggtctgttatctgatcaatttgatgacgttcactgctcctatgctttctgtctattagtcctcatgtcttgctgtggttgtccgattgtgccaagtaaaaggtattagattcctttcttccaaatgaattaaaataaattaaaactttttctgttttttaatctgagaaatgagtgatagaacagatcagcggttggcaaactatggcactgagtcaaacctggccagcaacctgtttttgcacatgcagttttattaaaacatagcttttgtggttcatttacataatttctgcgattgcatttgtgctggaacagcagagtttagcagttaaggcggagaccttatggccccatagccaaaattacttaatatctctccctctgcagacagtttccaatcactggaacagagtttacctctatataaagttattcaacaaaaaaagtgttttaattacattggatttttttaaaaaacaattctccaatgagatgaattctgaaggaagaatgaataagtctcaggtataaattttcattgtggtaatcagaatcacaaagccatccaaattctcaattttccttcaaatctaagagacactaacactctataccatttctgacccattcatcttgtattttgtaaagtttgtagagcctcttgtaagagaaaagatatggctcttgctctctgctatttggtatagaatctggtccccatcaactccatttctgattttggtaccaaaatagatattctttaaaatagactagtttttaaactgctgttgctggagaaaaataaattgcattgaaatcgtaaatgttgtgccttacattagaagtgaagattactctcccaggactacttccttttctgtgtaatttgactaggacaccacagtcactttcaaatacactgtggtattttacatgcaccatcaattagaacctactccccgagctcataattgacaatagacaataacatataggacaacctaacaagacaagcttcacaacaaatggccaacttcaaactgcagtatctagattttcaattaaataagcaaaggtgaggggatagattcatggatcaaattctctacaggtaataatgtaacacattaactgcctacagaaaggaaataaatctcaattgctaaaaaaggttctcatcactcagttgtcttggtgtcattcttgctttttaaaacaattaccatgccttagaattcaacagctctttctaacaaatagatgctgtattttgtgatcattacacatgattatatggcttatacattttattaaaagacagcttaaaatgtaggtggcttacttttttcacaaaaatgaaagaaaagggaaatttcttcttttaaagttgttctttacagagatggggtggggggcggaatttagtctcagatttaaggtggtctcttgagattaaataaggtgcctctgccatctagcggccgtcactggtaacacaactctggaacacagctctgatagctataataaaaccttagatttctcctatttagctccagacactcccttttactaaaaacataaaaaataagtttacaaatactattaaaaagtaaattatgtacagttaatagagtgcacattaaatgcatagaattgccttacaattgaaataatactacactagaaactaatgaggtattatattggtttaaaatactttgagttaaatcatatagatttgtggactctattacctgtgataatttttataacttcacaaatatctatatttataaattaaataataaataatatatcagcagtagtttccaaaaaaaatcatcatttcaaaaaatctcttgtgacatttaaaatacgggcaactgactgtccctttctgcacttttctatctcaccctcgactaccagatgatttacttgctcattcctgcatcttccctccttctctcatcctagaatttacatagatgcttagaatatacaaagtttagctttacaaacataaaatgtccttctcgggaatcattattattggaatttcctgactaaagttatctgacaatttttcaggataaagtatacattaaaccttaaaatgtcaacattttgtcaatttttcttttgttttctcccagtagtctgatttacataatggtttttgtcataaggtacatgaacaattaaataaatattgataatatagagctaaatatggtattataaaaaaatactcagttatgtgtagtataagaaattcaggtacaagaaaatactatttcacaaaatttttaagtgtagaactacatacttattaacaataatatatatattatattttgtttaaataaattagtttaagggtaactttccatatatcacttattagtattttattgttttccatcctctgaccatgtcttggatcccatgggcctcatgaaaggtaagcttcaactgagtttagaagaaatttgaagacccaggtaaaaaagaaaacaaatagtaatctcttgaaacctattattttttcctaaacttatacatattccttaaccctcagctcatttgtatattcctaaagcccatttatatattcctaaacccatatgtgccaacatatttttatatatactcatatgtttcacaaacacagacagtaagttatcttgagaaatgacttttaaaaatttggtgtcttgaataactatgatatagtcttgaatctgtaaaaatatttcagctggtaataagaagtatgaagagttttgggtttggcagcaaagtggtgaatactatggtcttacaccttaaaactctaaatattacaatttcattgttctttccacccctaatgttctttgaaattaagtagacatgttattctatacatagtatatctaattattgcataactattaatgctgaatttaaaaatctggcatacactatagatttcatcagatttttagaataaaaataactgaaatctgcttcaagtctgggtcagcaagatttgctttcaaagtcattattatattacattctcatcttaggttgatttattttattccttcacaatggtatttaattgcaactagaggaactactccaagaaaacttttgacaggcgatagaataagaacctggctcctgctgatacaggaaaaacttacgtttatttaagttggtgcaaaagtcattgcgttttctgccattaaaggtaatggcagaaaacgcaatgacttttggcaccactaatctttaaaccactggagatatttaactgcctcctccaagtatcagttttcaataaaatagattacctttataggtaggaggaacattgaaataatgaagcaccaaaagaactgcaaaatacaataatactggagagcctcttgctttagataatatgaggaggtcagtaacttaaaaacactagattgcaccttcaacagaggaaaacaaaagagagagaatatatttttaatcctgaagtaatacctggagtgaatcaatatgtgtgtggcaagtattactacacaaggagttactgtcaaattgcaccgtggcatacttattaaaagttccaggcactcactgcatgcttaatggtagaaaatggtcacatcaatctgtaatcaaaatgtgtaatagagagccccactgactcaccaccaggccaccctcctctgtggaaatgcttacattttctaagcccaggagcacaagaagtggaatcgttgtcattcctccttgaatccattcctccagagacacggttccatcatgatcatagtcaatttcttccatcatttcatggaggatctggagtagaggagataagggaaaattggtggtcaaccaataaaataaatttcataggctacaacatatgaaattgtgactaacagctaagtggagagttgggataactgtcttgctaactcagtacaacattaattctattactgatgaagagcgactttgttagcatttctaaacctggccacttaacactgatcactttttagaaataagtgcttaacttttcaatatttttcccatgaacagcacagctaaaacaagaagaatctttaataagtgtgaaagtggtctttaattactttcttcatattattttttagattcatatatatgccagaaaatgtctgaacaaattaacttcatggcaaagagctcatataattctttgctaagtagtaaggggcgaaggaatttagttgcttttaattgcctatcagaatttaatagagtcgagaagttaaaggatcaaatcaagtttaattaaacttcgtttctaaagatgacttgcacgtaatgtcttaaaatgttctctgcagtgtttgtttgcaatacatttacctctctgtggtatggtggcaatatcagtacttacctagaagggctgttgtgaggattaaataagctaacgtattataagcagacgagcccctggcatacagagtcagagtcatatagtgttgtttgtgctattattaatggaaattatatataagttccaaacatattacccttggttgctgggaaagcaaagtacttcccatctaatggcgtcaagatggcaaacatggtaagaattctaatgaagaaaggaactcacgtctttatataatacaaaaatgttaatcaatttggaaaaaagagaaatgcagagagcattggaacagagattggaaaagatgcaatgcatgaaatatttgatttgttggtagaagtattgtctgcctagacactcttgtgcttggtgtcttcactcaggaagtattgtatttgaaaattagattatttttctcctcttgcctctcaagagcttgctgatgaattagtagaaatgtatcaatcataagagaaataaaacaatgacatttgtttcagatgggtgatgctttcctttttgtacctaataaatctcatgttaaagccatcctctgaccgtgtctcaaatcccatgggcctcataaaaaaataagattgaactgagtgtagagcctgagttaatttgataaaaacttctagggacgctccagtcttccctactactattgtaatcaacctcaaatgttcatttctctctctctctctctttttttttttttttttttttttgagatggagtctcactctgtcgcccaggctggagtgctgtggcgcaatctgggctcatagcaagctccgcctcctgggttcacgccattctcctgcctcagcctcccgagtagctgggactacaggcgtccgccactacgcccggctgattttttttgtgtgtgtatttttagtagacacagggtttcaccatgttagccaggttggcctcaatctcctgacctcatgatccacctgcctcggcctcccaaagtgctcggattacaggcttgagccaccgagcccggcccatttctctttatttatatatgcaaacctatgagaagcctgctgatgtgtacatttgtttacaatgagaactactgaagccttaggcaagatgacaaggcagttcccatgacagcagacataatgtacaactttgtaccatttcagctccctggaatagtagcagacttatcagtaacacacatgtcaaataatgctatagtttattacttgtattctccattcaataatctgacaaatacactaggtatttgttgtagaaagactactcagccaccagctttccccttcctcctagcatcctgatgtcctttttctcaaatctacaaacacaccccccaacacacacaccaaaaatgcttttgttgagaagtgttagtgcccgctgtttagaaacctgaatggaggccgggcgcggtggctcacgcctgtaatcccagcactttgggaggccgaggcgggtggatcaggaggtcaggagatcgagaccatcctggctaacacggtgaaaccccgtctctactaaaaatacaaaaaaaattagccgggcgcggtggcgggcgcctgtagtcccagctactcgggaggctgaggcaggagaatggagtgaacccgggaggcggagcttgcagtgagccgagattgcgccactgcagtccgcagtccggcctgggcgacagagcgagactccgtctcaaaaaaaaaaaaaaaaaaaaaaaaaaaaaaaagaaacctgaatggaaaaacaaatccccctcccactctccatctaataacaagctggcttgattgacagatgactaatctgcacaggtagaaaggtgagtaggagaggagaaagctgttgtcgattacaagggcaacagaaataatcagaaattcctggctttcagtgaaaatattaaggtgagtcaaacaataaattaaatacatgttaccatctactttattattccacatacaaatgacaacctgttaatgacatctgccactcactagaagcacagcatatgcatttcccaatagctgctttaaaactggaaaaatcctaatcccagtaagacaggaaaatgctatcagagttcttgcagcatatactcatgccattatcctgttgtttaccgcatagatgtgaacagaggttaaatatacacttcttgaatttgcataaaatgtaaaatcatttaaataaaatttatttgcattgctttattcatatacactttgctaaaggttttaaaaataatataaactcaatatctcttatcaactttccccaaaatattttttgtggccaaagttatggtttcaagtcaagtatattttaatatgtattttaataatgttgaaattttgatgtttattcaaaataagaattctatattcttaaaagcatttttagatactctttctctaaacaatttaattaaaaattcctgactagctgaagagctttgggcaagtaattttaacatatttgggtctcaatttacttctctgcaaaagggaaaaaaaatagtgtatctacctcagagagttgaaagcaatatataacatatacacaaggtaacatgatgcactgtgcatggaaaactaccatcttcttttatggcatggcatggccttggcagtgtctatcaggaccttctgcttatccacatgtatgtaagaccaccattcaaaataacttccacgaggaagaaagcaaaagttactgttaacagcttcagaaccccacatataccttgttatcttattcagaatccactttgacttctgattagaaatagtaacttagttatcaaaagataaaatgaaatgacaggaatatatcagggtcccagacaagagaaaaaaaaagaaaaagaaagaaaagaaaaggaaggaaggaaggaaggaaggaaagaaagaaaaggaaggaaggaaagaaagaaggaggaaagaaagaaagaaagaaagaaagaaacaaagagaaagaaagaaaggaaggaaggaagaaagagaaagaaaggaaaggagagagagagaaggaaggaagggagagagagaaggaaggaaggaaggtaggagggagggaggggagaaagaaagagaaagagagaaggaaggaagagagagaaagaaagagggagagaaacagaaagggagatagaaggaaggaaagaaagaaagaaagagagagagaaagaaaaaaagaaagaaagaaagaaagagaaagaaagaaagaaagaaaagaaagaaagaggccttccagaatttagccaatagtgaaatcattcatatacctactggattaagttcagtgacatcccactcaaggtattctgcaacatgcatcatctgactgatgatattttctagctcctggaagagaaagagagataaaaaatatgaatacaagatcttagtgagttttaaatctttcacttgcagaaattgttttgttcaatgtgtagctaaaaaagttaaatgagttctatgggaatatatatatgtacataatcctttttaaaggtctaattaactatataaagaaaaaagaatcctgaatataaatttatcttgtacattgtctagaaattttcaccaggagagggcacaactttacaaaaaatacattttcttctactaaaagagagtgtctgaagaaagcaggaccaaatacatactgtcacatgtgatttttaagacactgaattccctgaacctttggcttgaaaatagatgtgaaagggtggacaaatcatttgaggacaactgagaagtctatttttatcttgatacactgagaatatacattgactgttttagtcatgtattgaataatttgctcttgaaagaagagtgttcagggccaaggtttgcaggacaagtatatgcagcatttattttgtgagaggatgaaattttagtttgaatttccatattattctgctcaattatcaactctttgaagaattgcaagttaatacagatgacctggctaaattaattaaaacattttcctgcctatttatctaatgttttaatttttctctacctacagaaaagattaaacatggctttgtgaaatgcttgtaatttcacatgaaaacattacataatttgaaaagtggtgttttaccgtatgatttaaaatgtaagaagtataaaagaataaagcttgaaagtgcaatagtcaaagagtattctactcaaatctctaatctaatatatgtagtcgatgttcatggaatagagaagaaatacgataaaacagattctcttttgggaagccgtgtttccctccgaggaactaatgaaagctatactccctctctccagaaaaaaaaaatataattatgaatatgttacttaagtaagacaggctgccccagaagtaatacaaagataaatgtatttattacagattaacaaattttaaaacataaatccctttgaattataggttaaaagtgtgcatgtgtatgcacacatgcattactaatctctcacctactccatctttgcttacatatgccttaatggtttggaagtgttaaagttcccggatatcttttaagaacagaaactatttttggtggactgttacgtaggcatgtgatattaggtaagccaccccacctaagactcagttttctcgttggtaaaatagctactctaactttacctccttcatagaattgcttcaaaggttaaacatgttattatacaaaaggcatttattttgttgtttgccgtattgcaaatgatcaacaaatcttaactattattattagaaatagtggacaattttcaaattatcattttctttctgttttgcctccagtaggtgaactgctacaccttaaaggtaccaagacacatgatgtcagaaggtacaatttaaacctgacagcgaaggaaaaatattggagtagtagctattgtggagaaaaccctagaaatgaaatccaggcctttaattacaaaaaaatagagactagtttaatcaaaactaaatatatttatccccaactcattgtttaatattgggactatagttctaaatattgctagtagtctactgtatatgctaacaaaaaatgggcagagacaaaaaaaaaaaggactatttgactgaattttcaaatcaactgccaacccatggctaaagcctagtaaagaatcatcattttaatttaattaaaaaagaaacattaaataaaacaactctccttgaaaatagaatttgcattagtgtagtcacaagtgctatactaagcatattaaagtatctagaagaaattaaaatttctagtcgtgaaatggcaccataaaatgagcaaatttattatgtagcttggtatttctaatgggaaactgaagaccactaggcacttaaaaataatagcatttgaaaaaaaatttttttttttttttttttgagatggagtcttgctctctcgcccaggctggagtgcagtggcacgatctcggctcactgcaacctccgcctcccgggttcaagcggttctcctgcctcagcctcccaagtagctgggattacaggtgcccactaccacgcctcgataatttttgtatttttagtagagacggggtttcaccatgttggccagctggtctcaaactcctgacttcaggtgatcgcctgcccgtcttggcatcccaaaatgctgggattacaggcataagccaccacacccagccagcatttgaaaaattactgagacttacagataataaatcccacaatcacagcatcaattcagagtgatggtcatttcctagagtaggagttatatattttaatctctctctggagaagctaatgtaccattatcctactcaaagttacataaataggcttccaacctcattgctttgcttttaaaagtctattttagctgccatagggtggtctatcagatgacgagaaaaactcactcattttcagagatcatgtctatttcagtcattattaaatatatcaaaacatttgtttttaataatattaaatacattaaaaatggtacacttcaaaatttccaaatgacacttattctattaatattcttatatttccttgatagaacaagaaataatataatatgcaaaatatgttaccaaacataaggtagattattggatagaacctgagatggaatttcatgcatggtactgatctgtgcactaagactaagaactactttctatttctctgaaagctagcaatgatttccatatattacaaataaacgtttaattattcccttcagttaatcatataaagatggtattttcttattttttatgactataactatacaatgtaaaatgaatattaaactggatgagatattttaaaagcaaagtttgtgaaagcaatctgtaaatacatttacctatttcagccgcatataggacaaaagataccatgtaaaactgggaaaataatgagataattaaactgactttatacatccttaaaattctacttatagtctcaagtttccttaatgccaaatgttacagatagtttttccctcattctaaatcaatggtttcaacttaatcttatgttttattcagacaaggctggtgcctttcttttttttacctaacttcagtgcaggaaaaataaaattaaaaaagtcatgctgtggtatgcaaaactattcagtagaacaattgtaatcccaacagtttcctcagatcactctctcgcaaaaagtcaaaaagataaaaatgccatatgagtggatgtaaattacattaagtgtgccttctgtggtaataactacaaatttattcattgcattcttcagaagaaaatctttgaagttttcacagaaactttgaagaaaaaaattaccgagctgtccaggaagccattcccatccgtgtcataaaggcgaaacataactagaatgaaagaggtgttgaaaacaagattataggcaaataagatcaatgttagtttaaagtatattcattaaaatttagtttgtgttgaaaacaaatactaaattcctctcctgctccaaacaattaatttgtgggattatttctcaaactaaattgaaaatgaattaattagttaatagaaatactggatagcataaagtctatcaaattttgtttgtttctagaagacactaaaaagtactattatttgtttaaactctttattacaagatcattaaatgtcaactcaaaactaaaagagaagaagttgaaatattcaaagcctgggtattaaagagcagagtgcataaggaaaaacaacaaatgtgaaatttagaaatcaactataatttgaaatccactattcacaattataagagcttggtcaaaaacttttctttatctgtaaagtgagaataatcattctaccataacacatattaactgtgaaagttaagggaggtgatagacacaaaagtgaatgtaagccatagatcatgatacaaatagatgccattgttaggattgatccccaagcagtatgggcgaggaaggcggagtgcaaaataacaggttctttctgatggaggaagccagcacagaaaaactgcattatgatcatggctctcatggtttatttgtttaaatctgaggtggagcttcagagggtaactgatgtttgaactaatcaagtaagggaaaggagaacattgggtctctgttagggggttcaggaaagcagatgacagaggtccctgatgggcctgaggattcccttgtataattcacacatccccaggaggctgtggaggaggccacaggtgccattttgagataaatagagaagacagacacagctgtaaaaatagaagaatggaagtacgggtttgtcttgggtttgtataatttcctgaatgatcttgatgtctgaagtctataatattaataaagatgttgattactaagcagcataattatataatgaccctgatggtctatttgtaggtgattatttttgtatttaatggttactgcatttcaccaattctaacatattattattaataagatgcataattagtctatatattgctaaaaagaaaaaaagttagccatgtcactataatattatatttattgtaagaggcaaacaaatgttaaagatgttaaagtgtaagaaaacaaatgtctgtctattgacttaagggcaataatactaaactggctaaaagacttaaatatctgtattgtaaatcatggtaatgattccttctcatacagtcaataaataaaatgcagaaggaaacagcaacttacaacattgtggatactaggcatttcaagagattgtagtgcagcagcaaatagtgaaaaatatctttgtaagtggcaagaattgacggactactcagagaaatgattaactaccaggaataaggcaaatatctagaaaagcctaaatatatttcagattgagggacatttataactctgttaacccttactggagtaaatgactgcaaaatgaccatttcacgtcgctcaaatttgtggaaaccctgttctgatttgttgaccttaatgggaacatgaactcaaagaaacacacatgggtaggatatatatagataatgggcattcattactgacagtgtctgaaacttcttcctattttctgaaaatcacactttatgaagagcattagaaaatgaaaactctagataccttttctttactagcctgacttgaagctagactgtgtgcatggcccaggctccaccacacagaagcacagtcccaggttatcaatcagatgctagtgacctaagcaaaagaagcttgcacagaatcccttctggtgatgggaggcggcagtgatttcagagagaatatccagggttctggatgagtcaggggtgtttcgaggcaaccatcccagcccaatttaatacttcatttggtcatcgttcctgaaaaggcagcctctagaatttgttctctacctctcccagtgattctgcatgctcctaaatatcgcttaaaaataataacatgctttattaaaaacaaccagttgaaataaacccgtttctatgtctttcccaaggatagtgtgtacttaacgttggttttaaaaatgaacttactattgtaatattacacttacagataaacgtattatttaacaccttattaaagtgtacacaccaatgtaactattacctctaaatcgaaaaatagaattcttactaacaaatcagaacccctttcatcctcccccatcattattttttcttctctctccaaagacacccattatcttgacttctacatcttttcttttgaattgaattgaatataacatttagaaaatgtttgccggccgggcgcggtggcttatgcctgtaatcccaccactttgggaagccgaggcaggtggatcacgaggtcaggagatcgagaccatcctgtctaacacggtgaaaccccgtctctactaaaaatacaaaaaaaaaaaaaaaaaaattagccgggtgtggtggcaggtgcctgtagtcccagctacgcgggaggctgaggcaggagaatggcgcgaaccagggaggcggagcttgcagtgagccgagatcacgccactgcactccagcctgggcgacagagcgagactccatctcaaaaaaaaaaaaaaaaagaaaaaagaaaaaaagggggaggagccaagatggccgaataggaacagctccggtctacagctcccagcgagaccgacgcagaagacgggtgatttctgcatttccatctgagctttgaagggagcagtggttctcccagcacgcagctgaagatctgagaaccggcagactgcctcttcaagtgggtccctaacccctgacccctgagcagcctaactgggaggcaccctccagcaggggcacactgacacctcacacggcagggtattccaatagacctgcagctgagggtcctgtctgttagaaggaaaactaacaaacagaaaggacatccacaccaaaaacccatctgtacatcaccatcatcaaacaccaaaagtagataaaaccacaaagatggggaaaaaacagaacagaaaaactggaagctctaaaaatcagagcgcctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagagctacgtgaagaatgcagaagcctcaggagccgatgcgatcaactggaaaaagggtgtcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagagagtgggggccaatattcaacattcttaaagaaaagaattttcaacccagaatttcatatccagccaaactaagcttcataagtgaaggagaaataaaatactttacagacaagcaaatgctaagagattttgtcaccaccagacctgccctaaaagagctcctgaaggaagcgctaaatatggaaaggaacaaccagtaccagccactgcaaaatcatgccaaaatgtaaagaccatcgagactaggaagaaactgcatcaaataacgagcaaaatcaccagctaacatcatgatgacaggatcaaattcacacataacaatattaactttaaatgtaaacggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatacatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagaggacctaatacacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaagtcaatgaatccaggagctggttttttgaaaggatcaacaaaattgacagaccgctagcaagactaataaagaaaaaaagagagaagaatcaaatagacgcaataaaaaatgataaaggggatatcaccaccgattccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagtttaccaaccaaaaagagtccagggccagatggattcacagccgaattctaccagaggtacaaggaggaactggtaccattccttctgaaactattccaatcaatagaaaaagagggaatcctccctaactcatttgatgaggccagcatcattctgataccaaagccgggcagagacacaaccaaacaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtatcgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaactgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagacggcatcgccaagtgaatcctaagccaaaagaacaaagctggaggcatcacactacctgacttcaaactatactacaaggctacagtaaccaaaacagcatggtactggtaccaaaacagagatataaatcaatggaacagaacagagccctcagaaataacgccgcatacctacaactgtctgatctttgacaaacctgagaaaaacaagaaatggggaaaggattccctatttaataaatggtgctgggaaaactggctagccatacgtagaaagctgaaactggatcccttccttacaccttatacaaaaatcaattcaagatggattaaagatttaaacgttagacctaaaaccataaaaaccctaaaagaaaacctaggctttaccattcgggacataggcatgggcaaggacttcatgtccaaaacaccaaaagcaatggcaacaaaagccaaaattgacaaatcggatctaattaaactaaagagcttctgcacagcaaaagaaactaccatcagagtgaacaggcaacctacaaaatgggagaagattttcgcaacctactcatctgacaaagggctaatatccagaatctacaatgaactcaaacaaatttacaagaaaaaatcaaacaaccccatcaaaaagtgggcgaaggacatgaacagacacttctcaaaagaagacatttatgcagccaacaggcacatgaaaaaatgctcatcatcactggccatcagagaaatgcaaatcaaaaccactatgagataccatctcacaccagttagaatggcagtcattaaaaagtcaggaaacaacaggtgctggagaggatgtggagaaataggaacacttttacactgttggtgggactgtgaactagttcaaccattgtggaagtcagtgtggcgattcctcagggatctagaactggaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcagaggtgggaattgaacaatgagatcacatggacacaggaaggggaatatcacactctggggactgtggtggggtggggggaggggagagggatagcattgggagatatacctaatgctagatgaggagttagtgggtgcagcgcaccagcatggcacatgtatacatatgtaactaacctgcacaatgtgcacatgtaccctaaaacttaaagtataattaaaaaaaaaaaagaaaagaaaagaaaaaaaaaagaaaatgtttgccaatcttttcttctcctattacaaaacaaaatgaaaaacaaaccaaaataacactgctggatttctaatgagattgtactgaacctatagatctgtttgggggagaatctttaaaatgctgagtcttgaaatctacaaccatattatattcttctttatttagagctttaatttctctcaataatatttcatattgttctgtatagagacctttcaaatagtttttaaagatttatttccaggtatttaaaaattttgatttgataaatggtaaaatttcttaaattttatttacctattattagttgatgtcatacagaaatacaagtgatttttatttctaccttgtaggcatagatcttgctaaacacacttattaattcaagtacttgatctatctatagattactgggtagtctataataaacaatgaatttcaatttcttctttcccattctcataaacttcatggatttttcttgccttattgccatgagcaatgatctccaacagaaagttgaactatacttagagtagtggccattcttgtcttgttcccaatatcaatgagagaaacttcaatatttcactcttaaatataaagtttgatgggtgtttcttatatatacacattattagattaatggagttctatactacttttatttcgctaagaatttttgctattacagttgttttgtttttaatcatgaatagaatgcatatggaatgtgataaaatacttttatgattttcttctttattctcttaatgtggcataatacattgtttcattttctaaagttaagtcaaatttaaatgcctgtaataatcccaaattgaacctggacatgttattttagctactttacatatataactgtacttgattgctaatatcttgtttcctttctgcttgttatctggaaaaatatatgaatggcttgtactttaatttctttaattaaatggaaaaagccatgcttccttctcccaaatatttgccctaaaaatccaagttgctttgatacttccctgaaaattttgaacaggtttttaaaatacacattcgttccaaattttccagttgattccagtaggaaggttggtctgaaaatccctacttcactagtgactgaagaaactaatattttaaataatttattcctaaacacattaacaagagttaatgctctataaatcctgtctaattcatcaaggaagaaagtttggagagttttaagctctagttaatataataacaataataaaaatatcatacatatattgagtaccaagtaccatatactctaaatattaccaagtcaaggtcaaggatagaacttttctttcatccagaagaagaaagagaaattcaaggactttaattttcagtgataagtctacttttctaatttaaaattgtagctaggtaatgcaaaacatgaagtattgaacacacatatttaccttggttttctattgaagtaccactatagtaacagtaagagatgaaataggtataaatctataagcagaaataaaatatgagaggagaaaacactaacacaattttcaggagctggagaaaatatgtacacatgtatattgacttagaggtcttagaaatataaatgtaagctggcagaggagaagaagcatagatttgcttagaaagggtggtgagttggaaaattaacagattatcttcacaggatgatctctggggagtatgtaagctctcttccccaacagaagactagatctttgagttctgcaaaagtgaaatgaaaggaattctgggctaaaggtactcaggaattctgagtataaggatacaataccaaaacaaggtaattatgtgaaagcgaatataccgaatattgagagaataagtccttttccttatccccagtaagtcaataccatccgtatggatactcacctatacaactactaccatcagaaaagttctttcaacacaagtagtttggaagaaaacaacaaagcagggaggaggggaaaccttataactaaaaggaaagtttcaatccatgaaatacaaataggaacacataaggatcaagctgagaataaaatggattctctgtgaagttaaatgtaaggaaaaagtgggaaaaatctcatcaccaggtataaaagatgtcccagatatggagtgaaaaacataagaagaaagaaaagaagatggaaaatagaaaaagcaagaaaaaatagtaattcagagttctgtcttggatgttcagcatccaaataatattggttctagaaagagaacaactaaaataaagggtgaaagtgattatcaatgaaaatattcaagaacaaatgaagaacgcaagtttatgaacataaatttatggtggagaatttgggaattgattagttatagaaatagagaaaatgaggcgggcggatatttgaggtcaggagttcaagagcagcctgaccaacatggtgaaaccccatctctactaaaatacaaaaattagccaggcatagtgacacatgcctgtaatcccagctactagggaggctgaggcaggagaatcacttgaacccaggaggcagaggttgcagggagccaagactgtgccactgcactccagcctgggaaacagagtgagactgtgtctcaaaataaataaataaataaatagaaagaaaaataattaagtaagaaaaaaggcaattattaactccatggaaaataaaagttgtttggcctggtgagcctataaaacctttctcttttaaaactatatttaaaaataatatagacattattaatattgaattttcaaattatatagtaagactatttcttagtattcaaaagtaaagtcaggcccaaaggtcaagggaatcactgaacaaaaggatcatatttttaaaaacaaaataaatatatagctgtttggctgcaaaaatttaaaaagcccaatgttaaaattattctgacaacacgacagcttccaaatatgggtatacctgcttcaatgttataaactagtttaacccacattttttcctatttttatgctcatgtcatttcactttatatagaaacaattatgcccacacacgtatttagttaaaagatcagagcaaaggcatattatgcaagataattttttatatccaaattttttttccttccaaaagatttgcaagtttctatctgttttcataatgaatatatcctactatacacactctggtgttttgcacttgccattatgtgttgttgatatgagcattatatgatatatgttattaatataaacaatgtaaaatatatttagaaaaggcacttaagctggaatttctttaattcacttttttccactcttgtatattttgatactgatttaataaactttaaaagcagaggtgaaaaaaatcagctgcttaggtgtgtttgacatccagtttaatggagagagattttcgccttttattcataagagaaacaacaataagaacaacaaaagacagcttttcaaaataaaaagagccctataaagtagctcagaaattatggattttagtaatagctagataaactggtggtgtaattaataaccaccctctcttggtctttttttttttttcattgtcaaactataggaaagttgactagatggtctttaaggtctcttcattattaaatctcatagtttctaaggttaatactgcacagggaagtaacttttaacatgtagcttactattcagtctccatatgtcagttatctactttctgaatattgattccctattgattttctctttagtgatacattttaaggaaatgtaagataatataaaaaattcttgttaaataattgataacttgataagcacaaattcaaaagtgaatatcatgtattttaaagtcaaaaatataaagttagtattattcaatatcttaaatagttgatgttatttttatattttcaagcactcattgactttatttttacccattgactttaatacacttccatttaactatcatttattgagcatatacctgttgaaacacacacacacacacacacacacacacacacactgatgtaggtgcaagggtacaaaagagagcaaaataaatccaattaggagatggcaagaagattcatgatgcagggtaagcctcaaatgtggactagactcaatcaaatatacactgtggggaggcagggggttgaaacccagcaattgcacattgtaatcaaagggatcaaagtggaaaagttcagggtttgtctgatgatagaaaagttaacccttgtgactaggacatggtttgtgcatatgtgtgcaggtcacagccaaagcaagcctggcagagtaggttggggtcaaactgtggagtcagatcggtgtatgcacgccaagttaagggtttcaattttacgcattatgaaatcaggaactatcaaaggggatttttcactctgaatcagaagagaaacagaaaaaaaataagtatgttagttgataaggttttaagtaagatgaaaggaagttgcaagaacatacacttaatgagtaagatgatgattaaataggtaggtgtttggaaaaaaaaacattatctggattaatttttaactagaaaactagacaagagaaacactgagcactgaaggccagctgaggttttgagtagagctataacccaaagaattatatttttatttcactaagtctctgccactcagtatagtataggagcaaataagttgaatgtctgaaattaagtgtgaaaaactaattgacatcatggattatgagatcagtttaaatttgaaaggatgggcaaccaaaagtcagcaagcaaattcaagagggagtaaagtgggcaagagtaaaacagttttaatttacttttatttcacctaacatgcatttatgggaagtaataagtgtgaaggaatgtatgtgaacaaatactagtttaatctaatcctcatagttatcccatgggacagagactatttaatgatctcaattttacagttgagaaaactgagtcctgaggaagttttaaaaatgaactcagatcactgagacagtgaattctcaacctagggtttgcattcaatcattataaatcaagagtcaaggtttttaattattgtactatgcaataattaaattaaaagtaggaaagtgagaagttaagtgaacataggctgggatcaaagtaaaattgacagtttagttttggaataatagcagttctcgacagttacaaggcttggagtattgtaacagaagtgaatggctgaaagaaaatggaggcaaagccacaggatttgagggtaaaagagaggttgttgactttccctaaagtactatggagcacttgaagttagaagggcaaatcagccctgagaccatgtccttgttcattcacagaggctgttggtaattggtaccaacaaggagagataaaaatggaattccccacaaccccaacacacacaggcacacatgcacgtatgcatgcatgcaaaagcacacatccaagggtaacaaacaccttctacctgatagagccttgggacgggaaggtcctcagagagaagaattaggattgcataaaggaaataaagctgaagacatggcttatatggtaagtcctcaatatgattgctagatactgggaaactgtgacttcaagcaaaacaatgtacagagggttctcgaataacaccctttccttctatgacattttgttataacattgataagcaaaaagtggttttgttatatacatttctcaacttcaagtcacagcttccaaaaccctattgaggatgttaagtgaggacttcctgtaatcagtaaaacatttgggaacttttgtttgttattctttaacggaataagctttataataaacatggtgtaaatacctggcagaaaagacaggcaatggaaagtggcgggaggcactgaatagattttaaaaatatttggggaaacaaagtattacttatataaacattgacaacagtgtaattcgtttatctaataacccaggtaaaatacctaacaaatactgccactattcatcaactccaggaaaaacaactgttgtgtcaggtgaattccttgtgtatatgtgttttcactggacagaaggaattgcataagccagtgcttctcaaaatgtgatccctagaacaatagcatccgcatcacctggaaacttgttagaaatgcacattttcagatcccaccccaggccagctgaatcagatataccagtcctgcaggtgactctgatgtgtgataaagtttgagaacctctaacctaaatcaaatttctttctgcttagctaccctggaagtatgagccaaattcaacattgacctgcaaaagttaattttaggtacttgttcacatctgtttctgtgttaattataattgctttttcttattttcattcttctggtctatattgtatttagtaaattgtaatccttttggagtatttattaaactaacaatcaacacaaatttttgaagtcttactgacaatttgtttttaaaaatctgtaactgtaaaataatacatgttagtaacttttacatatgcaattttagaagggtaaacatatgtggtaaattgttaagaaagtggatgaggaagattgattgttatttaattgacacaggaaagagccaggcattggcattaaaaaagaaaaagaaagaaaaccaaacttcggatgattctgatgtatagccagggtaagaatcaccagattagaagataggagaaaagagacctacggcatcatgtattttgaagagtttggtgaaaatgatagtgataattctgggccataacaagactgcctataagaagagtctgaagaaatggtttaaaacaaaaggaaaaggcaatgcatctagtgtaagcttgaaaaaaagctgggaaactcaaagaaaaaaacagagagaagggggttgagaacactaaagaaaagtaaatggcaggtcagtggatgagattcatcatgtctttttgaatagtgtggtgagtcaacattctatctgcaactgtagacaaaatctatgtgggttcaaggatgcacatggaaaactcaaaagcattcttcttaggaattccacctaaaaagcaatatacatccagctgacctagaaatagttaaacagcaagactaaataccatcttggggaggatggatggggcctttattcattttcagatgtggaaaaaatgtttgtctttatatgtttataatcatcccaaatgtgctcctgataacacctgagcaaactttctctctggctgtcacttcaatagaaattcactgaacattaatatttactttggaatgagacagatttctgtaagttcttaggaatacaaaataaatcttgaaatgcaaatattgaacatttatgaataataaatatatatttaaagatgatattcatatggtttattcataacctaagcatgtgtgactcttaaataatcacattacagtaaatcctttatgggaagaagaaatattatcaaaaagttactactaaatttaactaaaaatgccccccaataataattctgagacgtcatgattatttacatttgcttcagaagtgttaaagtttagatttgttatcttcactatcattctagtagcaagcatttttcattaaatttaccatatcttatataatcaaatttatcaggttattgagtaagctgccaggactatatttagaaagaacctcagagatagaatagatgatcaaatgatcaggtttagagtaaatgcttgaaaaatattttcttatattgcaatgagtatagttagccaccagagagagctcagtcactatgttttattaaagacagtaattatttactttcaactgaatagaaattctctatccgccatgtcctaaatttaagaaacaaagctattgtttaatgatttataatatccagaatcaaatactataaatgacactttcaggtttagcatttgaggaataatgtgtctctgccaacaagagtgttagtgctgaagattgcaagggagatttccactggggaaaaggtgcaggttgcatatttacaggcaattttcttactcactaatgggaaggtttcttcacacactagaaatacatgctttatgaaaacaacacaaaggctattttctaatagcatcttgttaactccagagaactgaggaacagctttttaaagtcatatgacaaacataggaaataatcagtagtaaatggaacttgataaataagaacctgaaattaatagatcttaatatcttttgtctgatcctcagcaggaggaaatttttactattaagcaggatcactttattcaacaaaaattatacaactatactaatgcaattttaagttaatcaatatccagtcctttctcctgcccccaatcacgataagtaaacaaaatgaagaaacacatacactcaagcttatcctcaggtcttcctctttcaagcagagacaggtaacagacaatgtccttcagatggattacttctggggaacacgtatttgcaggagaagtagtccggggaggggtgatggcacctttattcattctcagacctggaaaaaaaattgtctttatattttgttaattatttacagtgatctcaaacagaaaacaaattaagaaaatagagaacacacaggctacatagaaatttatattttttaggcatagaataaccaaattctctgtaagatcggtacagcagctagacatagcctacgactgttgtagatgaaggagagttctttgggatccacagacatggcactgccctatcagccacggatggtatttgggtcagaataatattaccctaggtgagttggtacacatttgaatgcttgaagacccacttccctattccacttttctgtgctttaggtagtgacagctataaatcatttgggaagatatttaaaatggactttttcacaaaatactaaagaaaaaaatgtcagtctttcacaatataatttctctattcataataagtaatcatccattcataaagtcatatatttgtttcaaatatttgccaataccatgaagaagacatccttttttaccatcaagggacttgcccaggagtaagaataaagagaacataagcaaaactctggataaacatgatggatattagagaggtaaaaacatatgagtggtttggtttttaaatggttctgactttatttctgaaacccattatctgtgtctgttctatcacaaggatataggttgcttattacctgtctggtgataatctaaccgaaatatgttcacagtaacttgttagttctgtcttacccagaagccactgaagtcagattgtgtgtatctgacaaggcctgaagataaaccgcaattatcccttgagggatatatggcatttttagaggtatttgggagaaataactaatgggttgagtggctactagattcctaatcaaccaggagctactgtaaggaataatttgaaccaaacacagttctagaaccctgttcttagcacagatctacctgactgcgtatgtctcactctactttagtttttcaatttgtaactttccatgaatacctatcacctcgtcaagccatctcaagattcccaggcatataattcaatgtgttgtgatatgtcccaagttagttttatcattggtgatgttgtcactaataaagggaactatttactgagtgcctaatatgtggctgaaatcatggtagtagctttaacacatattatctcacattattcttacgtgaacgctgtgaggtagagtgcattttccccactttacagattagggaccgtcttacagattttaacttcccagagtttcataaccagcaagacaaatccatcttcctgtttctacagtggtagcttacaaactatttttgttcaaggccaatcataaaagtgtaagaaaaataatttacatcttaacacagcacacacacacgcacgcacgcacacacacgcacacacacattagtgggattcataattgcccaaatattttcttttctatattaacctactcatattctatcctattctgaaaatttttctcaaacaccatctaaattgagtttactagccaccaatggatcaaaaatcacagtctgaaaaaacacggctttgggtctttccatccttttttatttttaattttttttatttttttgagatggagtctcgctctgtaacccaggggctggagtgcaatggtgcgatcttggctcactgcaacctctgcctcctgggttcaagtgattctcctgcctcagcctcctgagtagctgggattactggtgcgggacaccacgcccggctgatttgtgtgtgtgtgtgtgtgtgtgtgtgtgtgtgtgtgtgtgtgtgtatgtttagtagagatggtgtttcaccatgttggtcaggctggtctcgaattcctgacctcatgatccatccacgtcggcctcccaaagtgctgggattacaggcgtgagccaccatgcccggcccctttctttttaaaatgaagtcttatttatttcaaatgtggctttatgttttacattaattctacttctgtttataaagttatcaacagagacatatattgtaaacggaatttcctttttaatagaagtatcagtgtatgtctaatacaaactaatagttatttatgaaccaaagaaggcagggaattgaagacaatcctgagctttaaaaaaaaaaaaaaaaagaccggaataattgaaactagccaactaaagcttagccagctgcaggaataagcagttccaacttatgataaaaaacattttggcgctgacccttgacatgaccataactttcagacttggagaacacagcacttgaattatggtcggataagctatgacctaactcatcctgctgatgagctaatcctcttttccaatgtttccccctgtggtactgaaatgatttaatcagcttgatttaactcctttatagaaaaattcagaacaaaacaaaaaagaaagaaaagaatatgctctgacatttatttgaaagaaagccaaatatattatagatcttcacttatttagaacatggcatgaccatttgtacttatacaactaaggtagatggtgtttaattatcagctttcaccatactgaacacaaacaattgagaacgtaaggatcacataattttgtcttttctgtatgtaatgtataaatcgagtatgaatgtacacatataatttgtatttagcatcacgtttttgaaggaatatgctactgtactaaaattatttttgtttggaaaaatgagtaatattttccattttcttttcatgaaatattgttaactgaacacttaaagctgtatcatgtatttatcacatggaatacggttaaatgaatatttaaagctgtatcatgtatttatttccatgaaatattattaactgaatattaaagctgtatcacatatttaattgtgtcacagttttacatttaaatagcttaaagcttatataaaagaaatatgggcatatattcaatctatacattgaagaactaatcaactcttccttaagtccaatagcagccaaatttgagaggtaaaatatatatttttggaatgatttatagagtgcactgaagaagaagataaaatgtcaaagaccttttattattattacttgataaaaagaaaattgtagaacaggacttaattctttaaaactattcttttttaaaaagtttgaggctcacaacaaaattgagactgtacagagattgaacactgctttatatctttccttcattttcttcactcaagtcttgcttacttcaaatatctctctgtgtttcacattaattctacttctgtttataaagttattacccactacacatgcatattcctccccactaccaacattctccaccaaagtagtacgttagttacaactggttaaactacattgacacctcattactatccaatctctataatatacattagggttctctttttgttgtatattctatgagtttggacaggtgtataatgaagtgtctaccattatagtgtctttcagagaagtttcactgccctaaaatatttctactctgtttatttatctctgccctcccaacaatctctgaacctttcattttctcccggattttgcctttcccatagtgtcatagagctgaaatcatacagactggctatttagactggcttttttctgttattaatatgcatttacatttcctccatgtcttcttatggcctgatagctcatttctttttatcactgaataacattgcattgtctggatgtactacagtttatgcattcatcaacttgattaaattttgaggtgtttaattaataaaaaagcttggccaggcaccggaactcatgcctgcaatcccagcactttgggaagccgaggtgggaggatcacaaggtgaagagatcgagaacatcctggccaacatggtgaaacctcgtctctactaaaaatacaaaaattagctgggcgcggtggtacatgcttgtagtcccagatacttgggaggttgaggcaggagaatcgctggaacccaggaggtggaggttgcagtgagccaagatcatgccactgcactccagcctgggcggcagagtgaaactgtctcaaaaataaataaataaataaataaaaataaaaaaactcacagatttattcctgctcctaccacctccccaagatcagcccactttttttaaatgtttctttatattatattttcatttagttttctgaaagcagaccctggtcctcaatctatctccacaggagttatttttacaccctactctaccctttatttatttatttatttatttattcatttttttttcttttgccctttccctaaatctggctgaagctcactacttatcttcctcgattgcagttcactaccctgaaaaaagtcctttttccttttaagaagtttgcactaatctaatggttattcagaagcttaggagacaacatgtacggcaaccaaaaagttgcaagcctgacttcttgactacagctgagatggtaaaatgataacatgaaatagtaagtgagatcctttctagcagcaatagcctctggtgaggaagctcaaaattctatttttaattaacaaaggccaattttacacacccagtcatcagtgaaattctctctttacaactaaaatgaaacataaagctgggcaaaacaaaagggtttgtttgttttttggcctcaagtgatcagagctaaatattgcttcagagtaaatattgcaattgacacttaaagtagtataatctgcagattcttctacttgccctaggctatactactttaaatatttcatcacaaaagtgaagcaaatgtgtgtgtgtgtatatatatgtgtgtgtgtgtgtatatacacatacacacacatatatatgtgtatgtatatactacaatagtacaaaataaagtgaaaagtaagcattgtaattagagcgtattagtcttttaggaataattatcttgtacttagcatttatttctgttaaaataagttcattatatatacacatacatacatacacacatacacattcttttcttcaaagctttagttataaaaagtagttagcattagtcatatcgaatgttgcctatgattatcacatttctaagcacatgattttcattatactccaatctagacacttcatttcttgaaacaataacctcaaaagttgtatttaatagataattttaattccagcttcaggttcaattattagcagataagttttgggtagctgttaaattagtgcctctggtccagtttgtttcattttcaaacacttgcatttcatataatgtaaacagtgacattttctctatttcttaatgaaatagtcaaaaacaataacatggatcacatttctaaatttataaggcaatacaacactggcaatttagctttttcttttaaaatattggttcaatttacagaaacgtatcagatttatttatcacatagtataattatatttccaacatccatactattggtcataatgagtagcatagataatcagaataaaaatagttgatattagtattgtcatatatttcatgatttttacacttaatctttcaactatgcttgttgtagtatattataattatctttcattctttatgtttacccaaaccggcagcaaaattaggtagatggcattttcagtgaataagaaatgtaatagagatggtgattccttataaagagaagacagactgtgagatacagtccctgatatgaaactgggatcagacaaacctctctgagaacatactctggttttcatctgtttggacattggcaaaaaccccaaacaagcaattacagggagaaggacttaaagtataggtctttggggataacgttttaagagcagagtaacctctgtgaaggaacaacattaataacagctctggttgtgtgcaaacaatacttttgtacagtggtcttatttgaccctacaattctgttttaaagatgagaaagtggaaagtcagtaagtaaactgttcgtgatcatataccagtcagtcaacggagcaaaaaggtgaagacaaatcatctcattccaaactttggactctttttaaaagcagtaaaaatgagatctgtctacaccagtgttatccaataaaattttctgaaggctgagttcagtggttcacacctgtaatcctagtgttttgggaggccaaggcaaaaagatcatttgagtccaggagtttgagcccaacctgggcaaaatagggaaacttcatctctataaaaaaaaatttttaattacccatttggggtggcatgcatttgtagtcccagctacctagggggctgagcaagaggatcacttgagcccagcaattcaaagttacagtaagctatgatcacaccactgcagtctgggcaacaaacagagcaagattctgtctcttgaaaacaaaaaacagaaaacaaaaaacaaaaaaactttctgcactcttcaatacaataaaattaactacctatgtctatttgaccaaaattattaatgaatttaaatttaaatagcagtggatagctagtggctaccatatcaggttgtgcaggctctatactgtatgcagatggataattgaaagttatttaaattattctcagtaatttgaatatatataagtatgggacaaaaataattaaaccaccacatattaaaagagcccatgatgccaaattttctgtatttatcacatgaaaagaaattccaataatctccttaaatttcactgtacagatattgttcagaatgtataatatctttaaaacaaaaaggatatgttgatttttttttttttgagatagggtctcactctctgatgcccaggctggagtgcagtggcatgttcactacaacctccacctccagggttcaagagattctcccacctcagcctccaagaagctggaattacaggtgtcagccaccacatccagctaatttttgtattttttggtagagacggagtttcaccatgttggccaggctggtctcaaactcccgacctcaagtgatctctgtacctcagcctcccaaagtgctgggattacaggggtgagcaaccacgcgcaaccaatatgttgaaattgaactttatgctatgtatgcacaccaaaacattgaaacataatttatttaatgaataatggtaatgactggcatttattaagcatttataatgtacacaatactatttcaaatgaagtacatgtatcctgtttttcttcagtctcacaatagttaataaaatacatacacatattatccccattttacatctaagaaaacagaggagagaacaagttgcacaggtacgactcaaaatgcagtctgaattggagttttattatttatttatttttatttatttatttatttatttttgagatggagtctcactctgtcgcccagactggagtgcagtggcgcaatctgggctcatggcaacctctgcctcccaggttcaagcgattctcctgcctcagcctcccaggtagctgggattataggcacctgccaccacacccagctaatttttgtatttttagtagagacggggtttttttatgttggccaggctggtttctaactcctgacctcaggtgatccatggcctcccaaagtgctgggattacagacgtgagccaccgtgcccggccagaatcggagttttatactctaagcatgattctgtgaggctggacagagaaaaataaatcagaggaaactgtcttctgcctctcaataaaagacctttgttttaagagtctggttttcaagactcttaagggtggatacattgattaaatcataaacatttgaaagaaaattagaaaccatagccagagctaagaactctaaattttcatcttccatttggcccatgtcttgggccatccatcataatatgtttgtgaacatgtatttatatgtgtgcttgcatgtgtaaacatgcacatatatttgccaaatctttacgtatgatttttcttattgctcatctgtgtttttgatagatatacaactagccctttataatcataaacacaataaatattcaggacccttaagattagtcatgtaaaaccagaccccaggtactgaggataaagcatggaacaaagcaggaaaatcccatttccacagagctttcattccaggggatcaaagcaagtgtccaacaccattgcatattttctagctatgactaggtgtttttatgagtgaaataatgttatgatggatttgggcctctgcagggtattaaatctcttatttccttttgctagaatattacaaactgtaaataaatatttttgaacatgaaagtacaaaaatgttaagacaacactattatttagtatgcaaccattaagatgaaaatgaaaatacagaaactcctgtgtgttgggtgaataaatctaataataaagtaaaggtggaaaatttgaggaccaaattttacttggaatattcagatggaagaaaaaagaaacctgattattcaagtctaacatattaaaaaccatttaatgattaaaggagagacttgaagagaaatcatcccttactggcagtaattatgttaaaaacaggaccacaaaattattgcaaggaagaggttggcaggataaaatattttttgaagtaaaataatctgtggatcattacttctaatgacaataattagaagtatgaattcaatactacagaggtacatcaaatgtaaaggttgatataaataaatatgaattggccagtagacagaatttatttcatctgtattcctggagcatttctgtgtcagtaagtttattacctcaacagtaataagtatatcgacattaagaaatacaccaatatattttaaatatctactatgtgtcaggaattcccctatctcatagtcacacaagctatgtagtctgttcagtttgtgttttggggaccctgactttccttgtttgcattgtggaaactgaaataactgatcagttataaaagacctgttaaggtacagcacagtaataaaaaatacacatacacacatatatatttaatatcctcaagacagtcctaataagagaaatatcttctcagcacaattaatgaagtatacctttcagcaagaacattcagtaagtctatttggtgaaagaacatttctcccaaggttcaagtatctcattctcattgtacaattttctgttcttaattgattaacttcctgacagacattttccttttctatctaaaataagtacttggggcgtgactcaaatgcacagaaaacataaaatgacataatcctcctattgatattatagcttattgatatgtgtagcatcacagtgcaaattaaccattgcctcatcaaacaagcaatgggagagttggggaccaatgataaggcatctaatttttttcagagatagctgttactactctcaatctgaaatatcttctggacccttttataccgtcagcctcattctccttcatgatagctgccacctcactagcagtgtaattattttctggcttaaaatctcataatggctttccgatttcttctggataaaattcacaacttagcatgacaggcaaaactcttccccacctggccttggctacctctctcgcctcttctgcagaagcacaactggagtccaggccagatccagacctctcagtgctcctaacaagtctatcttcctccagtctcctaaggtccttggggctttgaccttgccaggccctctttcctcattccactccaggccatgcccgatacttacaaggtcatgagcatcatctgctctgggatgaacagaaatgacctttttgaactcctatcttagtttaagtgaatcatgaggatcccacattcccagtcatcttcagcctcaagctgcactttccagcctcctttttttttttttttctctgagatggagtctcgctctgtcgtgcaggctggagtgcagtggcgccatctcagctcactgcaactctgcctcccaggctcaagcaattctcctgcctcagcctcccgagtaactaggattacaggtgtgcaccaccacgcccagctgatttttgtatttttagtaaagacgggtttcactatgttggccaggctggtctcaaactcctgaccttgtgatccccccacctcagcctcccaaagtgctaggattacaagcatgaaccactgtgccaaggctccagcctctttttgtatacatttttgccaatactacttactaccatctgatatggtacacgtatttacttttctgtatgtctgcctctccccactagaatggaaacgggtttcattttctttctttttttttttttttttttgatggagtctcactctgttgcccaggctggagtgcagtggcgccatctcggctcactgcaagctccgcctcctgggttcacgccattctcccgcctcagcctcccgagtagctgggactacaggcgcctgccaccacatccggctaattttttgtatttttagtagagaccaggtttcaccgtgttagccaggatggtctcgatctcctgaccttgtgattcgcccaccttggcctcccaaagtgctgggattacaggcacgagccatcattttgctcactgatgtatccctaacaacttgaacagtaaatatcaatttataagtgatgaattttgaatctatgaatactgaatgtcttacagttcatacattgccctttgatgggacattaaaaaatttttgaatagaaatgtgtatgttgatttctctccttggaactcctttcacatcctttcccacccttacttactcccctctccaactttacctggataactccaatttacactggatgactcctgcaacggttcacctcctcttttcctctagttttatttgggctcctgtaggcacctcactcttttctccacatagtcagttcaaaagtggtttacaatatttattttattataatataactgaacacataattgttcatctttttgcttgactttaaaggatcctcagctttcctgtggaagttctagcatataatgagtttaaataaatagataggatgcatgaattaatgaatgaataaaataaattactaaatggcacacctatcaattgagtgcctattattatttaaagggggctaggaaaatcttctctttctttcttataaaacaattaggaagaaacaacaacaaaaactgttacgctgacctgcaacaagtaccagacattttctattacagatgcaacattttggacattgtgtagtccaacagaaacaaacagtatgagtgtttaaatgagttaatatactatattacgtcctattttaattactatattattaaagaaactaacagttactaataattgctgttgattgctatcttatatgtaaagaaaggtaatttctctgaaggcagttaattcagttaatgaatactaaatggttggagttggcatgggtggcgatggagaagggacagggatgctacaagggacaaatggtgtcttgtaaaagtaccagagtgccagggtttcttcccagttgcacactccaggtgtgccatcttattaatcattgaattcctagtatggaacacaccgcgtgctatttaattaagactgacactttagctgaggctttaaggaagcattgggttttcatgcgataagggcaaagaaacattatgtaagaaaactcagtcctgagtgagaaaagcaggtttaagtcacagcaaatagttggatatggggtgcatagggcagggagatggagcgaatagggctgtaggcagatgctatagcctacgtgacatggtgcttcatggccatggaactctgattttatcaccttcttcactgtgactctggatcctggagtctcataaaggttacttcaggtgggaatgaatgtctcaaaaggtggggatgactgcaactccatgtactcatgtatctccagcacccatgcccttcactaaagcaactctgctttagctagctttacatattgaggatttaagtttgcttgaaaaataagtttaattaaaaaatgctctgacagttgacagtgaaggcctgaaatttagaaacccaggagtaatataatcaggcttctgtttgaaagaacgttttggagatgggaagtcagggcctgctctgagagcctgctaattgatagtttatgatgaattaaactatgacactggcagaacgtttgggaagaagcagttacaatgagtactagagagtattttgtgattaactaaatatgggaagtgacgcagcggaaggtgggaggattccagtattttaggactgggaagtggatagattcttggatgctattcaccaaaatagaaggtaggaatagtagcaggtttgtgcagaatctaattaatgaactttcaaacacagttagtttggtatctaactgtttgaaagatttggacatccagacaaagtgttccatctaaaatacagtacgtaaatattatttgtgagctgtgtaggttgtgtggggagtaattgaggtacgttatgtctgacagtgccaatttgttatatgatgcaaaaaaagtcatgtgttgaaatgagaagacatttagataaactttaaaaagtttaaaaaatcaacataattgatctcggatacagtgccaataataaataatttttacattgttttaaaaaaactgaagaagtgttaaggtcatataaacatcgggtagtaggaatttatagtgacagatatctgcatatttattaaatttctcttaggttatgttgagtgttcaagttgtagggactgatatgggagatgacaattttgattgacggttgaggttgtgagcctcaaccatctttctgcaaccatgttgtagaaaaagaaagattccaactgattttaaaagtgtataaagaaggaaattaacaaatggtgggccccaaggatggaagcaatatcagaaattggtcattgaactggcagagacgagagattagagacctgacatttgcaatgacacagaagtggtatgaaaaagctggagagataatgcattagcgatatcttcaaaaatcaaaagtcaaatatggaaacagtagtagtgacatcatttttaaataggtgataagaggcacttatattacaacaaattatattacaaaaataagtcatcttcttcatgaaatgccaaatggatcattacatattacagtcaaacaaaacccagctatacatatgcatatgtataaatacatacaacctttatgcctatttataattatttttaaatttttattctataaaaactaaatgttttgcttttactatgtatcctgtaattgattatcattcagtagtgagcataattttttttccttttcagttttgttttttcttgagaagcccttattttttagttgctgtatagagtaaaagactacctactctattcctgctggaactgtggtaatgaaatatggtgaactataacagcataaaccaaaccagattgtagcccctctctgttcaaaagtctgttatttttcagccacaaaaacacctcgttatacattagataacagattattgcaaagcaagattctatgaatggaaaggcatttcttttgtcagtttctgagtcaaggctacttcagccttgaaaattttattgttgtctattgttccttcttcctcaggaaaaaaaaaaataactatcaaaggtgggtctgaaaaaaaaatagggttagatatagtcctggacaagacactatgtacttagttgtaaaatgtggaggccaagctttgaaaaggaatcagagtttaattaatcattgctgcatgaggactacatagcccatattcctttcatgtagtctgtgtagaatgcgtaattttcccaaattcaagtacaatctgtttttcctttttttttccattttgaaacctgatttgatttttacccctaataaatctggcatcttctattcagtagataatataggctattagaagaaaaggaagttttaggtttgaatttcttacaaaatcacctaatttatcagaattgttctctttcttccatatgtgatacagttatttagacagacaacattatccagaaatattttctcttctttctcaaaactcaaggacaatattgtatcttatagaattaaatacaggacaactttcttatttaattcaatttaaggtatgtgtgtgatacatttatagcatgcagcagagaacaaggaagttttaatttctagaatcattttaaaatgtccaacccaaaacactattaaactgtaatactacacattaagaatagatccactgaaactcattccgagaaaaacagcaagtgcggtgaggcctctcaattcatgattgaaagagaattatttaagaatctaaaaatattttctaagaagagaaaaatgatgataaacatattagtcaccatacatcttaaagggctatcatgtggaatatgtacacttgctttaaaaaagcttctatcaacatgtgattactttatgaaaaataagttacatcattaatagatgggaaggccagacgccatggctcatgcctgtaatctcagcacttcgggaggctgaggcgggcagattgcttgaggccaggcattcgagaccagcctggtcaacatggtaaaaccctatctctactaaaaatacaaaaattggctgggcattttggcatgctcctgtagttcccaactacttgggaggttggggcaggaggatctcttgaatccagaaggcagaggttgcagtgagccaagatcatgccactgcactcaagcctgagaccctgtgtcagaaagaaagaaagaacaaaagaacgaaagaatgaaagagagaaagagaaagaaataaagaagaaagaaataaagaagaaagaaagaaagaaagaaagaaaggaagaaagaaagaagggagagagggagggaaggagggaaggaaggaaggagggaaggaagaaaggaaggaaagaaggaaggaagaaaggaagggaagcagtacaacataaggcttaatattatggactcttcatcatattgtctaagtttcatttatggctcaaccatctatttcttaattacatgttcttgcatttttatttatcagaatgtccattattgaacttatctctataccaacacgtgtgtgtgtgtgtgtgtgtgtgtgtggtgtgtgaaatggagtctcgctctgttgccagcctggagtgcagtgatgcgatctcggcttactgcaacctctgcttcctgggttcaagtgattctcctgtttcagcctcccaagtagctgggattacaggcgcctgccaccatgcccggctaatttttttttttgtatttttagtagagacggggtttcaccatgttggccaggctggtctcaaactcctgaccttgtgatctgtccacctcagcctccgaaagtgctgggattacaggcatgatccaccgtgtccggcctctataccaacaattctatattctactttgtgatactagagctgggactcgctagacttgtggctctcctgggatccctgagctccttgcaggagatttttaaggtcaaaataattttcataacggtattaagatattatttgcttttcttactcttattctcttttgaatgtacagtgaagttttcaagaggctatatgacatatgatccagtaacagaaacatagcaccagatgtaatttacccagctgtcttccatgaagccaggcattaaagagatttgcaattatgcaaaacaatgctacccttcttactattttttgtttgtttttgaaaatagttatttttcataataatgggttattttttgttaacaggtagtggtttgattcttgttatttttggaatgtcccatctttaatatggcaaatatcaatagatatcatccacataaacataagttccttcaggtcttcaatttttaagagttcacagagtcctgtgatcaaagagtgagaaacactgctgaagacatttcttcattgccagtggattcctgttctatccatagagggcgctagagagagacgagaaggcacaggggttggggcggtggggtggggagtcgcgggagaaggggctggacccagcaagagaacctgctgctcctgttgaatctctgcagcgtttcagcccggtggcggtagcatgttgtctctacctgcagactctaaagcagtgtaggctctagtctctagctcatgtccacaccaacaaaagcacaatgagctccctgctaagcaatctgggacaggccacggtgatgcaccctcctcagaggtctgagttcctgggctatagactagtcttgaattccccagttaccagaggcagccaggaagtatcacttccacaaaagtccaagggctaggtttgctaggcaacccctcacctcagaatttcatcctagctccaaggaatcctttcctcagggcttctaggtggtgattactgccatctaagggcagcacatgtttccttgagtctatctacatcacctgtcttctctttttgctttttcaatcctttgaaacagcttaaccaattacactgttttacattgggtaatacagtgaaatctctgttttcttgactggagggagattgatacaacaggtattaatgtaagtatgcatctctaaaaagctacccataatgagagaatcaccatctctacggtgacacaaatttacagtatctaaaagaaaaatcaaatctctgttctgagcttacaaatctaaacatgtgaaagtatattggcaattagcaaaatagatattaaatattatacctttttagatatagttgctttgtgaccacattttcaaatactcagcaatctatacgtatctagttatttaacaagagcagttttccaaatttgatggaaatatgtcttcaaattattacctatacatagaattctaaagcaagtgatagataaggataaattatattttctctaattagctataattttactggaaacattttaaatgagtcacacaatcttattgtaaaagtctaaaccctgtaacaaaacaatttttatgcaaatcatcattcatcttttatgataactagatatttatttagcctttgaaatttgtactatataaatgtttaaagtaagtaaacttaccgcctgataggagagcaggcttactttttaccattggactagaatgaggaaacttgttgctaaatgacatgaaaaggtgtgcagtgaaatcatcaggaagctcggcttccaggaatgtcttcatgaatagtttgaaaccttcaaaatctattgtctggaaaaaaaaaatgtaaacatgtattttaagatccaaccaaatgttaaaattctgtgctgtgttcaaaatcattagaagtagaaatgacctcaaaccatttttatatccaagtttaacaaatggaaagtgcctatttgagaaatagggtgggccgtcctgggctaacactggcaatgggatatgtttgtcttacctgtgatggcatagcaggaagaggaagaagtttctagttagatatttctatttccacagtatctgtaatgccttgaaaaatgtactgtttgaaacttagtttgctcctctctaaactgggaataataatcccaccccacatagttgttgcagtgattaaatcaggcgatcactgtgaacaagccaatacagagtcatataaacacagcaggcactcagagagaaaggaattttccatattttttgcttgtcactaatggtgattatcgcttttgacaatgtaaaaagaggttaaccttaatgtttcaactaaatgccaagctctattgataaacctaaaacttcatacgcagactttccaaagaaacatattttaagatcttactctctgatactcattgcagaactatataaatgattagacatttatttggagagaattgtggtggtgttaaggttctccatgcccattagcggaaatggtgatggaagacaacttccaacctcaagcttaatgagagcgtttcacaggagccatagtgaagagcttggtttctccttgcagatgaaggcagtgcaccaggatttgactctgcctaggaaattgaggacaagcacatgggtgctttggggacaaaggcaagaaaatggtactattttaagttggccaaaactcctcgttttggactgcaggaacaatggtgcatgagtattttctgggaaacagatgtagaccacatggaggagaaggccagtggagtggtcttgggttctatccagtagggcatttgaaaggactagaagacctacagagaagaggctggaataaagccacatatgtccagatcaagagagtgcaagggatgggctttataggtagcccttgaaggccaatttttttttttttttttttttttttttttacccagtttaatgtgctgagatgcaagaggaaatttggctggctgatgctcttagttttgttcacattgctggcaggtaagaataaaattaactttggaatagaaagtttgtttttcctatgtaataatactgggggaaagacatggagattgaccgaatttattattgtattatttgggacaaacctaatattaaatgtgacattcaggaatatcattagacatagtaaatttttatagatttgatcatgtgccaattaagtttacatacgatgtttgctttttacctaatagaatctcaggcaataaaaccaaacactttatttatcaatagtcccaagattctgcctataccttaatctaacttttttatttagtttcactttgcttattgattctcacaaggacacttcagatatttattttgctggcagtaaaaagacttcattttcttctatatttcataaattactaccaccaccatagaatattgtcaattctagcccgggaggtggaggttgcagtcagctgagattgtgccactacactccggcctggcgatagagtgagactccgtctcaaaaaaaaaaaaaaaaagaatattgtcaattctagtagtagagtgaactatataactaaaaactctgagtaatataaaaaatgtgaagaatagcctcaggtaggagaagtacttccaaaaaagcaatttgctacaatgaattcagccaacacttaaaaacatggcgattaggccaacagtcagacatgggatccaaatagtttccttgaaaaggaacacctactcttactaagagagctccttagagatgacctattaaagagaagtattccacattcatttgggtgagtgaccaaaattgatagctaatcttcaacatgtatgaaggcccatgaggaaccaggagttgattttattgcaaagttgcaggaagtctgtgggatgaaaatattcacaagcattgtggttagaagcaaagttacttatggtagcgcttccttctgttcctaggtcttccataatcagtattttgtttagcaacataacagatgataaggggcatggtctttgaagtcagactacctggatcaactcttgaatccaacacaagctgtgtcactgtggacaatttaagctctctgtgcctcaatttcttcatctataaaattagaataatagcacctacttcttgatttgttaggaggaacatattatttactatttttaaagcatctgaatgacatctggcacatagtaaacattgtatgtaattaaataaatttttgtgtaaagaatatccattttaaaaattcataatttgaaacaatatttgaagaagaagcctcaaagccacattacttcacatgttttcatatgcatttaacaaaccatgcatggttcattgttgtccttgttgctgctttaaaagctggtaataaaatgtgaacttccagaagtagtaaaggactagaaattggtgaaagtttttctctggatctgcttttggaccataattataccttaaaacagctctttcaagccaagactttaacttggtaacataacaaacaaacaaaacaaacaaaaacaaagagttcagaataaagcaattgtgtttcaaattctaatacttccactcaccacctaactgataaggggcaaagaatttatctgctcttttgaaggaaaaatatgccaagtcccaagtgtatgctctttacagagcctttcagaacccatgtcgatgctcattaaaatcgctgcctgtaatttaacgatgaaagccagaaaaataaccaaccaaaaggaaaaatgaactttaatatctaacgatagaggcaggacacagacaaatgtctaggcaggtaagggaaggtccccggagaacctccaacctgcccaggtcactgtgcacaggaggcctgtctaaacacgcccatggtgaaaaattctgtcccataacacatgctcagtaagggaaataaatcagtgtggggtggctcagactaagggctcacatgtgcactggaaaaatggggtggagctaccagaaattcatgctctatgcaggggagaatcttggcctcttcagctcatgtgtggtggcctggtattcaatttgtgaggtggaaacccgaatgcaggaccctctctttgttgagagctttcctttctcttaataacttccaccctctttacccttcaatgtgtccgcatgtttaatttttcctgatcatgagacaagcacccagatttagctgaattaagaagcaaaaattcctgcatcatttgatggcctatatggggatatgaggaagagcgagtaaaatgcgaacccaagaatctctttcactttcgtttctgggccttccagtcctcagactttttctgaaggcagaggaaactgcaccccttgcgtcactcttgggtttgggaatgtcggcctcagtccaacccagtctttgctatggcatttttcttcttttttttcccaggactgtaatggcacctatcttttcttttacaatatcaggagtgttccaccccaaccccaactgctgccacataggatagatgcggaagtggtggctccctgccctcccccacgttcccgccgtgctggggcacatggccgtgtgtctgcgtgtctgctgtatgtactttcggcatccaacagccatgcagggcgggactgagccgcagctgctgcccaggccccagggcaatcttgggggctagaggccccgtgcagacagctggccagcgttccccgccatgcatccatacagtcttcccctcccttggccaaggagtccagctcagtgggacaacaattaagtttctctctgtttgcataagaacaagaggtttcttccccaggcatttccctgccctacgcttaagccttttttttttttttttctccacaaggtcaggagttgatggattggtgtgaaggtagttacagtttttgctattacctagattggcagggaccacagttgattttgcaccaacctagtaacacagccctgtgagtacagggggcttctcaatgccagaggatttttcttgaaaagtgttttattaggccaggactccaattcacaggacacccttttctctcccttgtttgagaggacccaattttagagcttcaccttagcatttggcttatgacaaggaggcaattcttttgtcccaaactcaattccaagctttgggttgaagccctaggaaagaaaactggatcttagggatccagaggcagacaacaatggaagttaaaaggcaaacaccacagatgagcatgactaattcctgctgattaagccaagcctcccatatcatggatagaggtcatactagtatccatggcataaattaggtgtagggaactcaaaggctacttatagcagggggaaaggcagtgagtgcacggggaagtgcggataatcccaccccctaggcccaactgttaacatgagtgaaagctgcattgacacccatgggtggcaccctgttgtggtcaccaggcctcagggatataaggataaaagaaggaaagaggaagctttttccttctctctctcatgtaccctgggcattcgataggaagagaaaggaaccagggatgccttgctcctctttctagatgagtagccattcgtcttcagtctgtgcaccttacagatgcattctgagctggggggctcctttgaaaaaaatgccttctttgtcccccttggtcctctcttcacagatggttaatcctgtctccatactacaggacactcctctcggatgcatccttcaaactgtgaaaagtttatttctcaacccttaaactggttggcttagaattgagctcaggggaggggaacccagaaggctgacatgctggcaaagagataaaatattttttaacagtcagacttttggcctccctctccctgtgcaaaccagtaaaaggaatggtagggatatattctccgtaaagttttgattaatcaaaaagtatttatgaggttggtctcaagctgtagccaatctgttgtgctctgcatgtctttctatatggttctgtcagaaagaggagtaccttaggatgggataaggacctaggaccccatagcccactattcaagtcagcctggcaaactgcctagtatgttgtttttgtctccgctattttacggtggcagcctgggatcaatcctggcttagggaatgagtagtttctggcaaatacctgtgtgacttctaccatttgctgattctctcctgctccatgaacagcttctagctttcttttgtgaatcttcctttctctgagctacacttagacgttctagtttttgtaaaaactgcttaccacccctttgaaaataccttgtatactcgcagttaaatcataactttttggggcttgttggtttcacctgtaaggttactgttggtaaagttcaaaagccagaaatatgagtcatctggcatggctaaagttgggtagctagggatttaaaaggattttcttaaagaacgctcaagttaattaaaagtggatatccaagctataggtatatttaaaagacctttatgtttttttcttcatggatcttgtttttctgagaaaggttttttccccagtcaactgaattgtcttcctccattttatcttgccactcttaatgaactcatgagagaccctaagataatttctgatgaacagagactacttgggaaaaatggaaaagatataatgtattccatttttggagaaacctctgttttcctcatggaaccccagtaattagaggcagatagatccctttcaaaatctgtttttgtcttccacctgtatctgcttattaggtactgttacctctgtttcttgaagggctccaccctcaggccaattatccaattaggagattggcaaatgaaaaatcttacaactactggatcttcttctgtctgtctatgtagttatatatgtgatttttatataaaagcactctaattaattggcctaaagaaaaataagcattagatcaaatattttttcaaggaaaatacaagctgtagtaacttttagttcatgtagctttaatctttgagaaataaaaagtcttaaagattattggtaaaattcaaatgtcattaaaatttaaataggtggtctacattatggaagtcagatactaggttcgctaaatgttttaaggttgtaaactgcttctttggccttagagaactgttcaacttgcctgctttacaacttggtaaggcctgaggacatactgaattaaccaagcccttgaacaggctagaaggaatcaaactttattggtgcctagtacataattaaaacaacttatcagattttacattaaagtttaaaattgctaagagttaccattataacatgtaattgagaccaccactgaaaatagattgacatgcaaggtgtgtaagaagagtaaaatgtgttttcaggaaaagattgtaagaaggcatggaaatccaagtaactttttgcctagggttaaaggattgttttaaattagataaggtcaagctaaaggtttaaatagttgtggaaggtttctaaatttaatattgcaaaagaaatcctgtgtatgaacattgactaaactcaaaggatattatatgtttttttctgtaaactgagcaatgaaataaaagcacaacaaggttttcttaaggtactaatctgttctttagcaaaatgtgtaaagggttataaaaggtttttaagaatcttacctcatggtccaactggcttagattggatagaattgtctataaggtttcattagaaaattgggattaatagtaaactaatgtaagggtaaaatttggctctctctctcccttgttgaagatttctatgtaatattaatgaataatgaaagattttcatgtgccttgtaaatagactgccaaggaaaagaaagagaagacaggagacaaactgtttggaaagctaagtccttcctcttgatgagtaaaggttttccctattttaaaatttttgagtcatcattttaacaaaataaccaactgggattgtatttcaaattatcaagtgttttaaacctctaacatttaacaggcttccccaaatcaaatttcagcttcaaggttgtctttcctgacccctagcttttggatgctacagagggtccctagagcatctagaagaagagaggtaaacagaataatttaacatggttaggtacatgggatctccaaaatgatgtttaattttcttcaggttatattttagtgaataatgctaacatatgttccagaattttatgggatttctaaaattctaatgtttgagtgtatgctatcaatcacaattaaggttgttatattaagttattgtaagccacagagataaccacattttgtcaatcacatttctgactgtaactaccctggtcattttgttattcataaacaattgtcttcttttgatccccttcaaaagatggttaataatcagctataaaagtttgatgggtgttctccaatacaagtttctgataactttggagactctaacactggactaaagggaaaacgtacaggactcatgaaagagctgaaacattcacgaatatcaagcagagcatgagttaactgaatggactgaactaatagaaaactgaagtaatctttttttaaaaccttttgcttgaaacattgctggtccttgttttgttattcagagtcaagaaaacttttattttgagctatttacagtctttaataattgagtaagctatactcatgtgaacaaaatttggagcatacttctttctctttgcctggttcttctagaatttggaaactatctgtgagtattcttaacttatggcaatatggttatttgcatcagtgcaataggaattcattttctctggcaacagtacacagttggagagatgggttgttttaccaaggctttgactggagaggtgtacttccttttaaggaatcaagcttgagttgcagagtcaataaaagccccttgggaaaactggcctcataccttgtctacacagtcctcatacagggttcctaatctgtaatgagtaaagaatgtcactttctaatgggcccaggaactctatattctaggaacctcaagaagagaggaattcacccaattcataggtatttgagggtgctaacccatggctgggctgggctttccaaagtcctatctgagattccttatggaacagaattccatcaaaagcaattttaaaagtgtatgtaagaataattattcttgctgcactttatgcaaactgtcaggccaagtataagactgaagtctattttgcaaacaactcagtcctatcatgaattgtttttaacaaaaatgaggactggggagataaaaattatgtttcaaaacttaccacacatttgtcattaaattctagtctcattagttgttttgaatttttttttgcctacattttacattaaccctcttattcctgtgaaccaaccagcaatttctggctacaactcagaagaaacaaaaggcatgggtaatgtaataatctggatcaatattttaattctgagcagttatcctgctaatcctgacatctgataggagtaaatagggtgcccataacccagaggttcctctgggaaaataagaccaaaggagcaaaccaaagccaagccccatgcaaccaatcttagcaggcataattatagccaccagttatctgggcatgctgacagccttgggatttttcagctgcccttacccatccctctttgtttggttttaatatatgtcttctaataactccgtttgtctcttctcaccttcaggccatcaaactccaagcgatcatgcaaccagagtctcaaacaatggccccttttaacagagacccttaaataggctttcgagagagttatgactgccatatttccaaaacagtgccccctaagagcaggaagcagttaagatcagtcttcgtccctattctaactgcagtacctcttgtgtaccactttagagggaagaataatagaagtaggaggcaaatgcctaggcagataaaggagggtccacagagaacctctgacccactcaggttattgagcacaggggggcttgcctaagcatggtcacagagaaaaattctgtcccttaacacatgctcagtagggaaataaatcaatgtgtagtggctcagactaagggcccacatgtgcactggaatgattgggcagagccaccaaaaatttgtgctttatgcaggggaggagcctgacctcttcagctcatgtgtggtggcctggtattcaatttgtgaggtgaaaacctgtgtgcaggacccctctcttttctgagcactttcctttcacttaataaattctgccctcctcagccttcaatgtgtcgcatgcttaatttttcctggtcatgagacaagaacctggatttagctgaactaaggagcaaaaattcctgcatcactggcatttctcctaataagcaacacatttcttcttgactcttcttttttcagcatgcaggaaaactttctgaaatttctaaagtatagttctctctggctcagcaagcaaaatactgttttattttctgacagctctaagccttaattccctctatataaagtggtatatgaaatcattcattcaggctgggcatgctagctcatgcctggcactttgggaggctgaggcaggcagatcacctgaggtcaggagttcaagaccagcctggccaatgtggcaaaaccccgtctctactaaaaataaaaaaattagcatggtggcatgtgcctattgtcacagctacttgggtggttgagacaggagaatcacttgaaccttggaggcagaggttgcagtgagctgagatcacaccactgcactctagcctgggtgtcagagtgagactccatatacaaaaaaaaggaatcaatcattcagagttgtcccaatatgataaaaattgatgtaaagcacttagcatacacttgggcacataatatataaaataaataaaaggattaggttaaaggaagaactgtcctcagcttagatacatttttaagttactttaattttcctttttttatttttttgagacaaagtcttgctcttccccaccccatgctggagtgcaatggcgtgatcttggctcactgcaacttccgcctcctgggttcaagcaattctactgcctcagcctcccgaatagttgggatcataggtgctcacaaccacgcccagctaatttttgtatttttagtagagacagggtttcaccatgtgggccaggctggtcatgaactcctaacctcaggtgatccatctgcctcggcctcccaaaatactgggattacaggtgtgagccaccatgcccagccaatttgcctttttattggtacagaaaactgtaaaattcattgcatctttctgaataaaaacttcaggttttgtgtgtctcaaatactttgctataacatttctgtgtcagataacagagacaaataacaacttttataaggcaataattctaaaaaaaaaatcttcctttgaaaaataaaagcctattacagatataagaatggagtaaaaatttcctcaattcttaaattatttctacaagatgacatcacattatttattgctgaagtgttactgacaatgtaagcttgtttctcaaacttcttcactgtgttctttggagcaaaattaatttatctcacattttctggcattagatagggcttgcaatgtgggaaaacacaaacctctttttttttttttttttttcctaagagaaggtctctctctgttgctcagattggagtactgtggcccaatcatagctcactgcagcctcaatctcccagactcaagcaatccttccacctcatcctccccagtatctgggaccacaggattgtgccaccatgcctggctaatagtttttttttttaattttctaactcagagttttcaattcattgagaaatgtttcttcaatgtgtttcctggttaacccgtcccttttcttctcttgttagtaaaatcttttcaaatatctcctaaaattctatgttgtccacattattagacatttctgataaatggatgatatcttcatctgtacattttccttagatcatgacttacaagaaaatttccaaatttaggcatcagagtttctattgctgtcatgtaacagcattagaattgctttttgaagactgtgacctttaaatagaatgagatcatttatatgcatatcaatgaagccattaatgatacaaattgggtcagacttaactgaatgactattcaaaaattgaattgctgtgggctcaaacacatccacgcgcacgcacacacacacacacacacacaaatgttcaaaattttaaaaactgctttctcatttttttccttaaggaacagccacagactatttagggagataacagagaatttgtaaagaagactgactgagggagctgctcagatgtcgctgccaaattggcacagattcaaggcacatttctatatgcctttcattattatttctgaccatctggatcctttgtttttaaatccctgttaatactaaagagaagacactagtattcatccatgcagattcaaagtgaatgaaaataaatgtcatcactctatccttaatttcttttggtagttttgggttgtagattttctcatattcagaaagtgttctttgagcacccactctgcaccaggctctgttctaggtgtttgggtaaagatgttactagaacacacaaaattccttccatgagggagcttatcttctaatgaaaggaataagaacaacattaatgtgctcaatctacaatgtctaatggtattaaatgctatagaaaaaaaataaagaagaaaaagatttcttgggggaatgtgcttgcagttttttaaatccaattatcaggaaatgagaagctattctttgagtaaagatttaaaggtgatgaggcacatatttgcacatatttggagaaagcacatttcaggcagagaagacagctagtacaatggccctgaggtataatgatgcccctgtgctagagaaatttccactggagccagtgaggaggagcaggaaattggagcaggagtgagggaggaccagagtagtagaatacaaggtcaaagactcaagctgtggcaatgtgtggactgggcagagcatacaggatattagatcatcaaaagagagttatagctttaatgtggagtgagtttttagtaggaaattccatgatctgactcatattttaacagaaccatgtgaccattataacacttatttgtatcagacaaaagatagcctatcatcagtttttatgtttttctaactagctcaccactaattaataagtgactcctaaaacacaaaaatgaatcattcaactattatagataaagcaactgtttgaaaccacaaagaaatcactttatctatcaaccaatgttgactgagtacctatatgtgtaaaatactatgcgcttactgggcaaagaactctgatgaaattaactagataataatttaaattaatcagagttttttttacagttccatttctatttcgcattctaatttatatcattaactaattatatcaaactcaaaaattgatatgaaggtcactgagcaaaagtatattgattaaatatgcagcatggctatcttactgagatttcaaaatacaattttttatgttaaaattcacttagaaaaatttatattttaaatattgcatttcttatgcttatcttgcactgcaattgactattcattatttcaaatttcagagagttccttgatagtcccctaaagctgtcatatagatagttcctttgaagagaaagagtacaaagtgtgaaaaccttgaattttaatttttaaattagttttggcaaatgaaaactattttagcacttcagagtcacatactccattaactctacctttacctaagactagaattatgaagactcagtagaaagacaattagaaatatattattttagtaaaaaataggaaatggccgaaagataatgctactacattctactaattacaaaaagcaaataatggattcgaaaaagtttaagcagaatatttttactatgatttcagtatgtcttttaatcaaggatctatagctaactgttttattcttcagctgaaatctattttaatctggtgtgacactgtcttgtcacaccaaacattttttggtgttgtcactaggacaggagtgagtgttactgaaacacacacataaatcctctaacattttctccttgaaaaataaaacccaataaaaatgtcttggaaacctttgtatatataatttcaattaataagatcagtttttaattattccttacttgtatgttcacttttaaagaaaatctccacagggggtttttataatgcacatatgagcagacagattccatgcaaaacttctctttcctgaagggctatatgatccaacacgactttgcatcactaagtgtatgacacagtcttttaccttacaggtcctcattatgtaacactatccaaatgttactatgttttaggaactgcactaaatatgttatatgtgtgctatcatttagtcatcacaaaacctatggacaaagaaactaaggctcagaaaagttccttaaattgcccaacaccacaagcttctaattgacactgaagacataaatatttctagcttcaatgcacattatgttatagttaaagcataattttctaaacagattttgcaatattaacacatggtataaggtaatttcccactggtttatcagtattagatgcatttgctgctgtgtcaaattggtctgccgtttgagaaaaaaaagatatacacaaataaggtataacaattaaaagtaatggtacgattattcagtttcccactcttgaaaacgttgtgttgactgtaactgtttttgtaaccttcgatgttcaaagtacaacctattactttgggtcgtatacctgaaatgtgttcaaatctgcccgcctccatctccattctgatgcccattgtcatctagtgttcttacttgattggactgcttccataactcatatctagtcttctcttctacccaagtccatgccccacattgctactggaggtatttttctaaatagagaatttaacttgttcacctaaaaatatgatttataatttctttcacctataaaacttaaaattcgtagacattctaagcctttttaccaaaatgtctagatttatattcctttagtaccctgcagtgttctttcccttgaaaaagctatttctatttctttttttttttttttttttttttctgagacagagtctcactctgttgttgcccaggctggagtgcaatggcgcgatctcggttcactgcaacctccacctcctgggttcaagtgattctcctgcctcagcctcccaagtatctgagactacaggcgctcactccctcacccagctaatttttgtatttttagtggagtcagtattttaccatgttggccaggctggcaggctggtttcaaactcctgacccccaaatgactggcccacgttggcctcccaaagtgctgggattacaggtgtgagccaccatacctggccaaaaaagccatttctaatgatgaaaaagcacaagtaaaaacaacagataaaccctaaaaataaaacttagatgtgacagagtaatgttggttttaacttatacttggaaaagtacaaaaagatcacctaaaaaccccagcattagtttttaacttctatatcaattgtttaataaatgttattaaagaaatgaaagaacaaacattctacagtgtgaatttaaataccacttttcaaagttggaatttatcattaaactaaggagagttacttgtttatttatttcccaaatgtatttatgcttgatttcaaaacttgtttgtaaagaaagcaattgatcacaattggtataattgtattttataattgtaggtagatttgataagaagaggaacatcactgaaactatattgatggtaatagtgaagagaagcagaaatactggttaacatactatttctgttccttgctaactaactgtgctagcaccatgcagttgtaggaagtgaagcaatacaacagacaatagctctgctatcagaacagcactcaggattgtggccaggtttgggaggggaagcaaattacacgtcatgttccccactcctaccacatggtggaaggaaattacttttgaatgcagaagacatcagagttatagttcctcaatttaaaatgagaaaatgaggtcctgagaaaataaaggaaatagaatttgttggtggtatatctccaatattctcactttcatctttggcatgttctctagaacttttctatgaaatcacattggtcattaaagtatgaccacagccactgtctctaaacattagtggaacaccttttatgtgcaagacacagagctatttattatacatacattttagaacctaacccttttaacagtccaataaggctgatgctctcttccttttataagtgaacaaactaaagatagaaaacttgtccaagatccgttaagatgaattcggttcagtcagactcctcagaccatattttctctgttatactttccttatcctttccataatggaaagggttgaatttggttctagaaggataattatagattacagtaaaaaggtttttatatcattgttaataattatatcagtgtcattatccttgttaaagacatttaaaatattactttaggcagcagcactacaaaaggtaggttttgaatccccaggttccttattaagggtaaaagcatattgtctgaatgcaaagggtatacacattaaaagaaactacaatacagagtacaaagtgcgaaaataaagcaagcccctgtggagttatgaaagcgtaactcagcctcaggccaaggaacatctactgacaggaaacatgtacggaggaaatcctacactcagagaacactgatagacaaagagcacacatagagcagtaatatgtgcaggctgtcattcttctccccttgaacaccctcagttttgtcaattctttctattctgtaactgcaattgcttgcctactaagccactgcacatgaaacaaagactgggcaaggaaaaggaaggaagaaactcactctgctgactctccaaaaagctagagcttattttgacatgaattttcagacagcctctagtaaggatgtaggttgtggagaaaggtgtgtttgttgggtgctcaacaaaagtcatttaatagccgagtcctgaaaatgtagacattcttgaatgactacattagagtaaatgaaaacaaatcatttactccaagggattgcctcttaagtgtcataaagcctatttagtccatatttggggaaacaagtttccagaaaagtcagagatgaaatcaggaaaaggccatgctctgaaatggaggctagtaaatctcgccacagtcaatgagttgccatgttaccaatgtctctttatagaatattgtaagatgtaggatctgtatctaagtccaccagtatcattctgatgttataattgtactttacgtgttggacatgaaattacagtggctgttgtcattaaaagcatcaaacaatttaagaataagaagaagctagtacatatccaagattgcccaaaggagacaatattacggttttagataactcatacattttagcaagaaatatttctacagtggcgaagacaattgatatagctactctagtgtgattaaaaatgtccatttagagcacctgaaaatgtgttgtaattctgtgcacccaactgaactactgttctaaaacttaatttacaaaacagattttcagggagagtggttgaagcaacagattgaataatcttcccaggagggcaaaatcaacaactctttgcttatgtttcccccacatattctatcacagcactgtagacaaaacaaaacaaaacaaaacaaaacaaagccttatcattgcattttaaatgcaattttaaaatttcccatggtaaattaataaattaagacttttactaaataaaatataatagcacagccttatatatcttcatgaaattagaaaaataaattccagagtctacaaaactgaaggccacacttgagaccctttttgtctattaaggtaccagctcctattaaggcacgaaatcctttgatggattaaaaattttgtcacatccagcttagttataacctatgagtattataggcaaccttgtatactatagaaatcatattggtacagaagtatagttcagtgatatggatgagaaattcatagatcatatcagaataaagaaagaaaagacagactttaatagaaaagaaaatgtcttacttggttaagaatgtcttgtttctgtgcatgcaaggaaagaaagaatacatgtgttaatgtaagatactttatactcattatctcatatctctgattatttagctaaaagttcaagtttacaggttgattttaaaacacaccctagatccataggcctcaaaaggtggttccgaaacagtggcatcagcataagttagaaaactgatagaaatgcaaattcttgacccccacctcagaaacactgaatctaaaactgcgtggggtcggggggaggcaggcagcaatccatgttttgacaagccccccggttgattctgaggtacactaaaatttcagaatcaatgactagatcaatctttgtatataataagcaaactgttctgacattagataaatataatatgtaacacatacagtgtgattaaaatattttagaggattaacagaaatataaccatctatataaaggtatattagattttgaatatgtatttcccattcctaagatatccttctattagcgtcacgcctagcatctctccatactcttaaagattaaaatatatttctatacacatctgccactttcttcccatatctcagctgtgagtggaacaatttggaattgaacttgaagtccaagatcaaaagaaaaaaaaaatgtgtggaatgctaaactggtttcccctcatactaccaaattctactgctctcaggagactatttacatggcctgactatgttttactgagaataacctcactgaaactggatctctgctacaaactagctgtaataacgttcttaacattatattatttacacaagagtaggtggaggctaataagactctctccccttgtcaggcatgagtcattaatatgtatgtgtactgggaagtgccacactcactacaaaagcaatgtcttcccatgccttcccctaacctttctccttcctatctaagaggatgttcctctcccctatggcttggtcaatgaagtgaagagcacagggcattagccttaaactgggattctagtcaattaggtttttgttgtggttactgtcacaagctagctggtgaatcttggacaaatcatttcacttttcttaaaatagtttctttatttaaaaactttgtaattttattaatttgggaatctcaagacctttgaatggtttttattcctacagaatctttaaggctattgtttagatttctcttattcatttcttcaaggaatgattatcaaatgatctttaaaagatgggaattaaaagtaaatgattcattcacatattatacttaatattttttctctattaaaatagacttcaacaggtcatatctttttgggttaaatttttatccccagcactttaaaacttcagtaattcaagtgaattataagcaaaatagtacatctacgatttaaacagctttatgttgtaggaggataagcaatttaatttttgcaaatacattttatgtaaatgatacaagctatgttccttttagaaaacgatgaattaattattcattccaaattcaggttgcattactcaattgtccattttttcttgtataattcagcatcattaactagtcatcagtgcaaacaactttggggtcaacttgaccagccaatgcagagtgataacttcacatgtgaattgacattaggaattctgccatattgtaagagtaattttttataaattggatgaggtcatgtattgaagagaactttaagggcataaagatttatttctcatcattagatattcttaattattttcaattggcttttagaagatacatactagttttttaaatggttatataagccttaaaattttcttccgaaggaaaaattttatgaaaattaactaagatcagagagtggttttgctcttaatttagaattgttcttgggttgtaatgagatctaactttttgtttttcaactgttcgttattttaataacatgtttcaacaatagatctgtacatttatgaaatgtattacattgttgaaaagggtgatatgtgtgtctaataatgatctaataactacctcaaaaaatgcagcatatggtgactgataattctcatgaaatatataattacagtaagactaagtcttgagagtcctataaataaaaaataattgaagcaaaaaggctgctttgcaaacaagatcacttaactgagtttgtagccagcagctatcattatggagaaaaacaggttttatctctgtatatagattagataagcatgtaagttttcaaatattgttgtgaatataaatattaatgacaatttttgtgtcttatagcaattcagtgctataattcatctttacgtttcccaccctgctttcttaggctttgagattctcagttttgtaagtttagctgctaatttttttttcctcctcctctatggcatctagaaaaatacaagggaaatgtaggtcaaacatctattttttttctaatacagaaaaagggaacggctttaaatagcctttattttctccatcatttataggcaccaaatattaattttattttttaagaagaaaataaattccaggctaaagagttttaaaagttacagtaatgtaccagaatgtagagagaataagaaaatatgacatgaaaaatagctaactacgagaaatactgataggaaatttcaaaacaatttgaatatcttgagggttatgataactaaaattaagttctagaaatcccagggaagtacaatattgaaagataactaagaagtgtgctcttgcaaacatacaaaaaaaaaacaataatagcaaaaaataagtcacattttagtcagcaaacaaatctatctagttaatacatcctgacaaaagggtcttttgcaaagagaagtatgaagcaacgtaaatgttgccttctgaagctgcaaatgaactaacagtaatgatgatcgaacatttaaaatgtaacatctctcaactaatattaaataggttatttaacaagcaattaggaaggaaaaggcattcattccagcatggtattcaaaagcaattgacaagacatgcaaagttttcataagaaaatcttaaagaaatcttaagcttactggtaaaaggtaaaatagaagattaaaaaaattcctccctttttgtacaagttggttccttaaggtgacggaccaggtataagcaacacaaaatccttctttggtcaaggaaataattgcctgaaaggggtaactccctacccctacaccaatatccattttggattgaaattcgtgggtcatagactgagagccaagcatactccttctctattttatccaatgctgtttcctgacttctaggaaaagaaccaacgctacacttaaatgattcatattctttcaagcatacaatatagaagagttatttgaacgaaaaatgtacaacatttaatatatcttctagaatagcactgcattatgaacttcattttgtttatgttatgatacatggtaaatggtttatggtgtgcatatatatatatatacacacacatacacatatacatacatctgtatcatacatatataatgtatatgtgtacatatacatacacacacacacacatacatttttccaagaattgtttattaagaaataccctcttccaagcatatatacgaaactgatataaagaaaaagaagttttaccccttcaggattatactttgcaagcacaccattaccatggaattcttcaagaacatcctttaatttctttgtagaatctataaaaaacagaaaacacaaaaattgtttatatgcacatactgtggttgtgtagcccagtccagaaacagagaccacttaaaatgtaaataagcatcagcagaaactaaatttaaaaaccaacacataaaatatctcttgccatttttgaaaggctatttaattggaaaagaaattgcaaaggagcaaaaagatcactgcattaaataaaaacaatacagctggataagaaaaatatgggtagctaagcctcaatggtgaatccatttagagggacgctatagattttagtatctgtagatatttttaaggagaattttctctgtatacataacacaactaaactaaagcctactttagtaattaaagttttagtaagtaagctttaatttagttgtgtcacatattttaccctatatatgcattacgaataacattttagttttgttatgtataaattaaagcttaccctattcaatgaagaaacaaagcttagacatattaccaaaagaattataaattattttcttcaaaagtactattatttttaaacctttcatcttattagttggtgacaagaaattttaagttaataaaataatgtcataaaagaattatcagtattacaattaaagttaaatacattaatatgatatagatatatacattcagtctactaaaatatgctcattatacttattgaaatataatttttgatttagaaatctcagaattacaacgcatttttaagttagaaggaaataatagctaacaaatatgggtaagtcatctaaatatttaatcaagtttgaataataatgaaaaaacctcaaaattaaaatgtaggaaatacatggatttcccagttttcttttatggaacagagcatggaaaattattggctaccaattgaatataattcttgttgaccttccctaagagtcagtgatacttggactaccacaaaatatttcccagttccagaaaactaattcacaaattagcttttgaaacatcctgctagaaaactctctcatagatgcccattgaatatataatgcctatattttgtgaattgtacttttacttggaatgtaccatttcctttctttatattgtaaattctgtgggtttgtgtatgtgtgtgaaacaatagatagatagatagatagatagatagatagatagatagatagatagatacatagatagatagagtttcgctcttgttacccaggctggagtgcaatggcacagtcttggctcactgcaacctccatctcctgggttcaaccggttctcctgcctcagcctcccaagtagctgggattacaggggcttaccaccatgcctggctaatttttataattttagtagagacagggtttcaccacgttggccaggctggtgtcgaacccctgacctcaggtgatccactcaccttagccacccaaagaactgggattacaggcatgagccaccgtgctcagcctgtgaaacagtacttttaagtgagataaaattcgtgtcacataaaattgacattaacaatttcaaagtgtacaattcagtaatttttagcatattcatgatgttgtgcaatcattacctctgattaatcccataacattttcatcaccctgtaaagaaaccttatgcccattaaacagtcactccctgtattttctcccctctaacctctggctatcattagcctattttctgtgtctatggatttgcctattctggatatttcatgtaaattgaatcatataatatgtttcctttgtgtctggcttctttcacttagcttagtgttttcaaggtttttccatgttataacatgtatcagtacttcactcctttttatagctgaataatattccattataatgaatatactccatttaataaatctatttatcagctgatgtacattcaacttgtttccaggttttggctgttaggaattctgctatgaacattcaagtgtacacgtttttgtataaacatataattcaattctcttggctatatacctgatagtaaaattgccagatcatacagtaactctatgtttagtgttttgaggaactgccaaattgattttcacaacagctacaccattttacactcccaccagtaaggtgtaaggattccagtctctctatatccttgccaaaacttgttattttctaaccctttttttgttacagccatcctagtggatgtgaaatgattcgactcacatctgattagtcattcgctaatgactaataatgctgagcatctttttatatgcctattggtcgtttgtatattctttggcaaaatgtctattcaagttctttgaccattttttaattggacggtttgtctttttgttgtggacatcctctggggggtgtgtgtgtacgcacatttgcttgatgcctatacagcttcctatgtatttcctttttggtgtataatttgctggcattttccatattgtgatcagagttaattttttatgtcatgtcccttgctagattggaggttgttctcgggcagaaaatgtgtgttttcattttagcacaactttcaacttcatcacaaagttgaaacaatagcattgcaataaatattgagattaaattaatcagagctattcctaaatggcaaaaaattacaataattgcttctatatgtactttgttagacacttacactgcagagagagaccaaactgcatatcaaaaagagacatgaagctgaccccttattctcaaattcttctttgtgggtaataaggcactattctaagttagcagaactgcttttacttctttttatccataatcgtagatgcaacccatactgtgcagacccacagagacacacacatacacagatgcatacattctggaatatcatatctcgagagactatgtttattttaaccatatcttaggccaatgataaaatggaaggcggagaaaacaattttggtttctcccacataggcctgccccacaactttagagacactgcttagatggccttttcgtttcaggtttctatgagagtaaaaaacatattcagtaattatttataaatgactcagagaaggggaaagctcataaaattattcctacaatattttattagtgtactggtcatagtttatactgaatattcttagtagagaaatcatgagctaaattaacagccaaaaacctctagatatatgactgccctttccatgaactagggctcaacaatgacttggtctgagacaatttaaagtgctctagttgatattcagatgaatcactatcaattcaactcactgcctctccaattctcaagttccagttctaatatcttaatatttgaagtttaactatgacctgatctccactttacaatctagtttggaaactggagcattatcttgtttttgtattcctgtctcaataacatttcttgggcccagtttctctaaggctgaggccctgatttgaccggtcaatcttctaaagataaggatttgcgcatggaacaccagagagttcaggatatccataacctttcaacagcattgtttttacatgaattatctacatgtcttcttggacacccaaattgcactaggttgtgaaaatcctactgctatgttttaccttcttttggggggaacacacatttatcttatttgtaagttaactgcttgtccaaatttcttcctatggcctatcaccataaacattcctatcttttttattgtgccaactctgagttacattctgtccaaaactacactggggcagtggagaggggaaaggatctataactaggcctgacctgccttctaggacaaaataaacagaggaagttatacctggatgaacagatagtaagacgtggcctcagtcataattcagctaataatagagcttcgggaaagagcacagtgacagatactaggctgagcaatgctgagaaatccaggcaagcagccagccaggcaggcagctgtgagcttggagatcagtttagtaaatacatgtctgtaatgggagaaagaacctggaagattggccagtgaagtgctaggcagcccagtgctgagcagccaggttgaaaacagcaggtttagttcttgggataagggagctggacagatgcgcagcacaaaagattgggtctcctggaaagcaaaggaggggtatgacttggggaaattctgaaacatggggctaatttcagaggttcctatgcttggcttgactggcagggcaggatacttggaaaacaacagtgaatacaaattactgccctttgactaacatatccattttcccagcaagtaatttaatactataccaataactacagctgagacaatgggctgtctttttcatcactgtcagaatcaacttagagctgaaaatggtactgagcatgaaagcgggaggtgttttattaagcaaacattcttggaatgagctgggaaagaacaaagaaaatgtttatggggagatgagttgactttctcctatactttacctttctatcacctgctctggtacttgagtaattccaggggccccccaaaatgcacacaccctgtcaatcttctcatttcggctgagtcatgtaataaacaatgccatgagagttaaatgaactacattttagggatcaacgttaaatttttatttacttttaaaatgttcagaatttttaacgattttcaagaaaaattaaagaccctttacattagtctgaattgaaaataaataaatgactaatagcatttggtaacgtttagaaaatgcaaatagatcataaaaagtactacatgaaaaatgaaacacttagttcctctcacatctctttaggcatctgttacatcttgagtgagtctcctttgtgattttcctgcctctttgtctctttattccaaaaaactcaacacatacttgtcagattaatctcaaaggccccatgaagtaacggagagatttaaagccagctagatttagatttgaatcttggctccagaatgcttggctgaatgtccctgggcatatttttaacctctctatggttcagttttctaatatttaaaattagaataatgatagggatctggcaatactgtgtctagcaaagtgtctggtgcccaataaatccttgttcctttatttcatcctaaatgtgactttaaacaaatcatcacccttcaactgtttcctgttgcttttggattgaagcacaaactcctcctcttggcaccataggtgtgtcaaaatatgatccaaatctatcttccaacagttattttctgtatcttccatatttactattcaatatccattcatccaattgtgaaggcatcccatcatcccatgattttagagctcttcttttgctgatgatttttttttcctcaggaatcccgccaatgttgagtgaagttcaacataatgtatggcatggtttatctgtcaacttatccacaaaatctctcaggacctcctcaaacacagtaggttgtaactcatcctccatgggacaccccataataactctctcagaatctacatctcatttgtgcattgggcactagtaacactattaattatagcttgaatgcatgagcattttagagtttgcaaagtgttctattatctcatttaaaattcacaataatgttaacaaatattcactccacttaacacatgaagaaatcaaagttaaggaaattattacctacttaggatcacacagctaaaaagtttcacataatgattcaagctattgtatatgacccaaacccattctcgtcactttggaaaaagaacaaatacaagtttataatttggcttaggaacctcattattacaacagctaaaatcacacagccaaaagaatgtacagtagtgattcaaactcctatacagtaaatatattttaaagatcaaggccaataattttgccacctaaatagtagtcatagctgctgtgagaagactatcatatattctactgttaaagctaagacccaacttacaaaatgcatttgtcatttttgtaaataatgtgtttttagtggactgactgtaagttcattatctggtgtttttgtttttaaccaaaatagtgccatgtttcccacgttcagtagagatattggttttccaggctaatatgatagtttttacaaagtgagagaggctcaatgggaccatggaaaagtcatctttcgggtctctcaattcagtgctttcaaaagtttcctttaaaatctaagcctccccacatagctttttcctcttatcacaaaagatattcgtggtatagaagacttttcctgtgctcagcaaaaaagcattttttcaggaactatattaaccctgtagtagagagggctctgcaacttcaactgtttaaagagaagatttttctaatttaaatacttagctagcattaatgtgcagacgcattaatgctaagtatttaaattagaaaaatctttatcaattatgtcaatgttaaagttataattaatttatataatttaattgtataattgtatagttaaattgtattaattgttgtgcagacaacatagtagcattcagtccaatgttacatttcataaagtttcccttagctacatagtacttaaaagtagtgaaatagtgctttatcttcatttaacccagtaatactcaaacctggatccatatcaggatcatccggggatcttttaatatacactgatgtttgcactcaaaacacagtgaggcagatttaattagcctacatctccatgactggctagtcatgaggacctttaaaaaaggctctcagttgagtcttatatgcagctgagatggaattaatcactgctctgatccttaaatacatgcataaagaaagtgagagttaatcagcaatttttatcctgctaaattttcctatgtatgaatatatattttgtctgattgctacacggggaacttcttttagggaagaaaaaaaaaacctcatgagaacattttatttaaagatttatttactctcaccttaggtcacaatagcaaaaatagcattttggaatccagcagagagatccagaaaataatattgtcattaaatgaaattccccagatgatataaaagaagttctacttagagccagcagcagaaaataaatacctacaggactatagaataagagatttagagaactagtcaataagaaacagaagtttttatctacttgtgtgagaattttcataaaagtacaaagagattgaaaaagaaatatggaactattgttaaaaataataacagccatattgtagcagtttatatgctatttgaaatctatacacttggattttttaaaatcctaaaaataatattctaatgatactgctacagtgggaaaagctgtacaaaaaccaaaccctctattcaggtctttgctccaggctcaccacaggattctgggaaaatcctttaagctgctctgagtgcaagtcactctctacttgttcctgctaagcatttgggatcatcgttagcttaaaaagataatgggcataatatctttgagcaacctgttacacatatagcaataagtatttctacttagcaaaaataaaaactagttaattccaaaatgactacagatttgagaacatgaagaaaatttcctttctccttttcatatttattatcgttgttaatcctcttaaacatcagtttttattaactctttcttgtatttgctggtaatttttactccttcatctatctacatctaatgttttgatgtatgaatctaatccaatgccttgcacaaaatatttgtaagagtcatttgttttgatagacaaatatctgctaatttagccagcaaccctatccagacactaggaacctatgaaataatttccacctttatacgtattttattgtgtagaaaatacattaagaaaaagagtatacttgccttcgagccactcatctatactataactaaaaacttctattgaaaacataattgctaattaagagatactattagggacagaattgactggtgtggaccaatagtgtgctggtaaatgtttaacaactctttgggatgtgaagggtgcctactgtagtgtttgccaattgctgtcttgtaaatatttccaccatgacaatttcaagcctcccacatgacatcattaatgtggagttgggaaagaatgctaacattcagctctgataagcaataattaatgaatcaatctatatgtgattatttgtactttagaaacaataaataggtctttaaagacaaatctggagataaagaacggaaataaaaagcctgcagctatgacttcttaatcattctttcaaatattctcaagccacctattgagtttagaacaagtactgttccaactattggaatatatcattgaacaaaacagaaaatatgcctaatcctatagtttgtattctagtgcaagaagatagattacaaacataatacattattaagacaatcttatatcaatgcagtatagagatgtgatggcatggaggtgttagtggtggagtaggaaagatgaattattttgaaagtagagccaaaagaatttccttattgattggatatgggttgtgacagtaatgtgtcaagagtcccagagttgtagatttgagcaattggagggataaacttgccaataagtaaaatgaggaacactgcagatgaagcatgtttggaatgaggagtcttcaattttagttttaggcattttatatttcataaatatattagatatccaagtgtagccattaggaaagcaattatttatgagtgtggaacccaatagagaagcctgggctgaagaacgaaatttgagtataatttctatataaacagtatttaactggatgacatcacatgtatagtgattgtagatagataagatagcaaggactgagttttgagtctcagttcactctgcagttcaagtaccaggaaaagagatgcaatctgctaggaaactaagaatgaatgcctagtgaaatagcaagaataccaggaaaaataatgtatcccaaaagcaaagtgtcatgtaatatcaagttaaatgaggagcagatttagcaagacttttaagtttagccagaaggaaatcatttgtgtccctttcaagggctgtttcaattcagtagctgggaaaaaaaaaataaacccagagtgagtttaagagaaaatatgatgagaggaatgggaggcagcaaatataggcaactcattcaaaaacaattttttgccatagaaggaaagaatttgggcagtagctggactgcaagaagtgaaggcaagataaatttttttaaaaaaagagaaaaaaaacagcattctaatagaaattattcagtcgagagagaaaaaaataaaaaattaaaaaaaaaatttttaaacacccactagaatgttgtcctttagtgggtaagagagaatgcaatcttcttcatagcagaaggtctggcttagagtggaggcatggacagtttacctaagtaggaaggcagattgacaagtgctgcttaattaccattcactatttgtcatgacatcattactattggtaagtggatataataataatgttttctttgtccttaggctgggattagtagctggtgcatagtatatattcattgacagtgagcccttatcatcatcatctgtgccatcaggcttaagctaagctccggggatttcatttttctataaccttaatttcagattattcacaattttcttaattttcttttacattttcactagatgcttttaacttcctctctttaaccaacaacttgaatacaatataagatgtcttaaagttatatgtaaaatagaaattgtatatttttttgtgttgtaaaattcacttttgtgggcaatagaattaaatgcagacattttatgtgtgtaaatcaaaatgtttaaggaaatgcaagtatgagttacatttttgaatgtgtacattaaaaatatttaaacccacgctagttcagaagatgacaacttcattttattttttttaagttcttatgtgggttgcaaaacacttactggcaaaccaaacattctggcaacaattctgtattctctagtcacaacactaataacatcctgttttaagacaatacaaaatcattaaagttgacaattagtttctgaacataaaaagattcagctctctgtacacttaccaacaaacacaatattaggcaatgtggagaaaccaaagtctatttatcctgtgagcatatacattttaaggaatattatttgctcacatacatattttaaagaacataaaactccaaaatattgttcccaaatcttacattgagaacaaaactcaggaatgtgtcatatttaccttgtgactttatgcatccactcatctttatggtatgtccggaggcatgaagctttaatgtgagaaggaggctataactaactggacacataattaaatgtagttgaagaatttgcttccagatcttggctcttagatgatctataggatattcttctcacaaagtagaccttcattttctctttctaatacttcaaagaaacaatacttaaggactcttccaggtacagcattctctgattctatgatagtgcatatctccacatacttactagaacttgcagccccacatctcctaaacattcccttcccaattcagaaagagataattttctagcacatcaaattccccaatggtatcagtacctccagtgatatttgcactggtgttataattcaggaatatcttcagaattacagttattactctaaaaataatcatttgatcaagctctctaaaagtttatgttgactgtattaagctgtgaacattgcctacaatgtgacaatcaatctttacattttttaaaaaatttaggggaggagaactgactggaatcaaaacactgcaagtatgcatattgtttcttagttctgaaaatccctgtgaaatagtatttagaagggaaatctataatcttgatttgtacaaaatggcacctttcacaatctatgttcttacattggaacatttgttataacaaactttgtcataatttgctatcaaattaaaaaatacctgttcaaatactagctaaatgtgtagggtattttaaacgagatgatttatgatgtatcttagccgtatttcagacattcatctggtaaaaacaaagctacccctacactgtgtaaacatttttaaagataagaaagaaagaaagaaagaaagaaagaaagaaagaaagaaagaaagaaagaaagagagagagagaaagaaagaaagaaagagggagggagggaagggaaggaaagagaaaggaaagaaagaaagaaaggaagaaaggaaagaaagagaaagagagagagaaagaaagaaagaaagaaagaaagaaagaaagaaagaaagaaagaaagaaagattttgtaaaggagtttagttacaaagccagtttgatatggttttagagatttatagtccatgcaacattgcactatctgaaaatcaaagaagagcagttgcaatgtgtaaggctaaagcagtcttcaaagtgaattgtagaattcctttgaccgatgtgcttatattacaaagaacattctcagtcatgttgatattgggatttttttttaacaagcaccatctcataaatttatttagtaatgaaaaaaaaaactgccaagaacatcaaacataaaatctgccaaaggaaagcgaacactatttatttgtttcctagggctgctataaaaagttaccacaaacctggtgatttaaaactgcagaaatttactttttcataattctggaggccagaggtctgaaatcaaggtgtcagcagggttgtttttttctgaaggctctcataggaattagtttcacacctctcctctagtttctggtggctgctggaaatccctggcaacctttggcttgcaaactcatccctccaatctctgccctgtcgtcacatgatcttctccctttctgtctttcacattaggcttagagcctatcagaaatccaggataatctcatcgtgatatatttaatttgattatacttacaaatcacatcaaatgtaattacaaaataatttacattacttttcccaaatataaagccaccttaacagtatccagggcttaggatttggacatatctattttaaagtggaaactaattgaactcagtaggcaaaactttaaaggtgatgttcaaacaaaccttctctgatgcatagccctaaaatcctaatggaattttgtaaaattgttatgtggtatgttcatttagggcctctgagaagccttaagttgcaagaagctggtaggaacacctgtgaaggataaagaggagcaggagtaggcaaggagcgccttcagactatgacactggtctaacagcagcgagaggggacaagaaggtcaagaatcgggttgcaaggcttcatactgtggtatagctctgagaatgtctccactaggccaggaaggagttctccagcaacatcatccattgttgggattctctgttataaagaaatgtcctggattcaccatcacaactgcatttggtcattgcctgggagcagtccagggagagcatgcctccatgtcagaactgtagcaaatctaaagtgtcatgcctaaatgaagaatagatagtcaaagctcatgagagaagttttctgtaaccattcatcaaaattccaagaaaaattgaagaaggaaaattttgcaaatatagttcctttgatatctctagggaattctagaacatcccaggacatcattctaggattggtgattgtgagacaatatccaagagatctttatgcctcctagcaccactgttatgattagagccaagaggtattggcaaccttgaaggcatattgtggcaggccagttttcactaacagctgaacagacaggcctccatgacaactgttttagcactgactgagttgttaatttaaatattaaaagcggatagagccagtgctcttatacaaagggtggaatgtaacaaaagcccaccaagagttttgcctagaccattcctgggccttgaagcgtaagaagataatgaaggaattcttcacaggatatgtttagaattaaataagttttattgggggtatctgaaggaactcctcacacctccactaacaagttttattggggtctaaatgaactccccaaatctctttgatttagcatgagcaaaataagggtagccacccctggcacctggacccatctggttaaagtaaatttactgaggctccagaggaaggtcttcaggactctcagaccttagttatagattagaggttaatcacatatgtctttaggtaaatacaaacttacatgtagacatatagctaagaaggtatacaagctctgggaaactgtaattttcagttggtctggtgatattttcccagcattctccctgtacccggtaacagaaataaactctcttctttcccagtttgtctgcatctcgttattgggcggcaagaataagcagcctgaccctcactttagtctgggaacaatattacccaatgctggtgatgtagtatctaaagggggtgcttatatagatgactttgctttgatgaaggattaattaaatggtcttgatagcaatgaggacaaagctctgattttttttcttgcccaaattcttttctatggggtctagggaattgggccttacaaatcataaattctcatcatcagatgggttttatttaaccctgtatattgtgacttactttccagtctgattctggcataactagggaaaaaatcaaaatatattttccccaaaatatatttccctgccataccttgaaaatgccctgcaaagtctcttttgggaaaaatccacattcaatagagaatccccttccccctttgttttccttcctttctttccagatccaggagataatcaactaagcgccaggcacccttttaggtctgataagaaacattttacaacctgctgtctccctgaagtctgatatctgagagatttctctgcacagtaatacttgatctccacaattctttatcttaacctgaacactcctttccattgatcccaggtctccagataaactcaaccaattgtcaaccagaaaatgtttaaatttacctagagcctagaagcccccggctttgagctgtcccgcctttctgaaccaaaccaatgtatttcttaaatgtatttgattgatgtctcatgcctccctaaaaatatataaaaccaagctgtaccccaaccaccttaggcatatgttctcagaacctcctgagggctgtgtcaagggccatggtcattcatatttagcttagaataaatctcttaaaacattttacagagtttgactcttttcattgacagcaagtaggtactcaaattggtcaactgggctatgaaaagaatctcatgcctaacaataaataaagtatgaaaaaagaactggttctacagtttgtcgctaaacttccaaaatttttttgaagagaactacacaaaacagatatgttaatctggtgtggaggactgtcttaccacattggatagtaaaaatgttgaagaatttttatgaaatacacttacagaaaagaattactaaacttaattcttatgaattagaagagaaagcatgcatatttgatgaaaatctttaaagtttagatcacatagataaaataatgtagctattggatatgattatgacatgaatgcatcacacactcttcctatcatctgttacactgacaccaagaaagtgaatggaaagagatatccaatgtgaattttaatcctcccattgttgctgtctatggcatcagctgatagttgaggatggacagccatccatttccagagtcaaaaccaccaggaggaaatcatccattgttttcttgtacttggacatagccagacctcaggcatttactttctgcctttctcacccctcaccagttccctcctgctcatccttccccttcagcaagcagcagcactgactacatcttccagctttctcttttcaccgctgtacctcaattgggttatcttcaatgctttaatcttcaaaagaaacaaaacatgccttgtctcctatgttgctttgttaagagttaattctattccttgtgtttttaacatattatttattcttcaagcttctgcttagaagaaaaatgtaatttgtatctaatactttacaagacagcatcattgtatatagaatggatatgtactaataagcacataaagtgctaaataattaggtgttaaatgattaaataattgatactttagtgctttatattacgaaaaagtctttgttgagttttatatacatgtttcagtatttattattacttgggaaaatttggttgggtgttttcataggttgagaatgcattcttattttccctactaaaaataacagcatacaggcccctactattaaaaaaatcaatgtttaacatgtttacaataatgtgttcgattcagataatgaaggatatatgcattacacttattatgtagaactaaaaggtacagagtcagtgaatttaaagtaaatgaagaatgacagagaaggtaatgaagagaccacaagagtgagaaaagcaaaaaatagcattgtaagttaaccaagcagatgggacagtccaactaaactggaacagtgtagtcccctttgttagctgctctaaataaggggttctatcttcacatatatagtaatataatcaacaatgaggggcacaaaaacacatgatcaaaaccctctaccttagaaaaagttccagaaagaagaatgggatggcttttgctgtgggcaaaagctgagatcaccaggacatgtagatgggtcataaataaatatatatatatacttggcctacattttgtgggaaattcttttacattacatcctgtgttgttagtgctaaacagttacatttccatgaacccacattgccttttaagtgttttgtagtctctcggcaaagggggaaaaaggctcctacacaataagctcattttcctgagggtgtggcttttgcaaatggacttaaattactagaatttgtgacagccagctgccttggtttttgtttgattgtttgtttgtttttgccctgacactccattagtgttatttattctcactcataggcttgggaggagtgcaaggacaagttaaaaatctgtctgaatgactgggcagaaaagattttcaagccatagagaaatgtcttaggcattgttgtttctctaatgggaagagcctgagaaaacacttggaaagtatctcctccaaagttacagtcgatttggagaaaagctatctaaataaagaatatttcaagaaattacataaactttgattgttaccttgcaagaactttgcctaaggcacattgtccaagcactacagaagtataaagaagattctaacttgattggatatttgttccacttgaaatctgaagttacggaaaagccaaatagaggctgtatgaaatggaaaatgtcaaaaatcttaggtctcctcttattcacatattattatcactattactttgctatagcatactgatgattttacttgaatgttgctatgaatgagggtatctcattgatgacttaaaccactggtgctttgaaaatgttatttaaaacttggatcataattgaatatcaattattcttttctcaaccttagaatatatatagtcatatgcaacagtcttctccaaattattcgattttctcaggaaatccaagttaataaagacagatggtgaattaagtgaaattggcagcaaatttatctcaatttttgagatttttaaaaaacaatgtgttattgttttagaattctctaatttctttcctccctgtcttaaatcttctttccatcacagatttctttgcatgccttggctgtattgtccagattgacatcatattaagtggcatgtgtttctttgctattaagctgaagtggcttttatgtttacaggcaagatcattgcattttttatgattgtgtaattaaaaatgcccatttcataaaaactaaaagcacttaaatataagaatatataaccttccatgatttttctacctggaaatgactactattatcactgcagtgatatccttctagaatattttgaattcgtgagcataaatacatatttagaaaattgggatccaaaattacgaaaatggaattagggattacatggcattttgaagctactttttaatttaatatatttaaatttattttcatgttaatatatatatattcatactatcaacagtattgcttgaatggtaattcttttatagctgtaccacaatttcatttttcaagcagcctcttattttgagcatttaaataactgttaaatttgtattcatgttaacagtaaaataaatgtgatatacatacgttgatatggtttggctgtgtccccaccgaaatctcatcttgaattatattaggttggtgcaaaagtaattgcggtttttgccattgaaagtgaaggccaaaactgcaattacttttgcaccaacctaataattcccataatctccacatgttgtgggagcgacctagtgggagataattgaatcatcgagatggttacttccatgctgtttttgtgatagtgggtgagttctcatgagacctggtggttttataaggagcttcttcccaatttcgttctgcatttcttgctgccaccatgtgaagaaggatgtgtttgattctttttctgccatgattgtaagtttcctgaggcctccccagccctgctgaattttgagtcagttaaacctctttcctttataatttgcccattttcaggtatgtttctattagtagtgtgagaatggactaaaacagtaaattggtcatgggaggagtggggtgctgctgtaaagatatccgaaaatgtggaagtgactttggaactgggtaacaggaagaggctggaagaatttggagggctcagagaagtcagaagaatgtgagaaagtttggaactttccagagacttgtggaatggctttgaccaaattgctaatagtgatatggacaatgaagtccaagctgaggtggtctcagacggagatgaggaactgttgggaactggagcaaagattactcttgctagccaaagagactggcagcattttgcccctgctgtagatacctgtggaaatttgaacttgagagaaatgatttaatgtatctgatggaaaaaatttctaagcagcaaaacattcaagaggaagcagagaatgaaagtttgaaaaatttgcagcctgatgatgcgataaaaaaataaaaatccattttttggggagaaatacaagccagcagcagaaatttgtataagtaacaaggagctgaatgttaatcaccaagacaatggggaaaatgactccagggtatgtcacagaccttcacagcaggccctaccatcacaggccaggaggccttggaggaaaaaatggtttcctggactgggcccagggcccacctgctgtgtgcagcctagggacttggggccttgcattccagctgctccagctatggctaaaaggggccaaggtatgactcgggccttggcttcagagggtgcaagcccgaagccttgttagcttccatgtggtgttggtcctgtgggtacacagaagtcaagaattgagatttggaaacctctgcctgaatttcagagaatgtatggaaatgcctggatgtccaggcagaagtctgctgcagagccagagccctcatggagaacctctgctagggcagtggagaagggaaaagtggggttagagcccttatacagcacagagtccctactgtggcacaacctagtggagctgcgagaagtgtgccaccatcctccagaccccagaatggtaggtccatcaacagcttgcatcatgtgcctggaaaagccacagacactcaatgctagctatgaaatcagccaggagggaagctgtattctgcaagctacaggggtggagattcccaaggctctgtgagtccacctcttgcatcagtatgacctggatgtgagacatggagtcaaaggagatcatttttgaattttgaggtttaatgactgccctattggatacaaacttgcacgggccctgtagctcctttgttttggccaatttcttctatttggaagacgtgtttttacccaatgcctgtacccccgttgtatctaggaagtgactcagttgcttttgattttataggctcataagcaaaagggacttgccttgtctcagatgagactttggacttggacttttgagttaatgctggaatgagttaagactttgggggactgttgggaaggcatggttgtgttttgaaatgtgaggatatgagatttgggagagctgggggcagaatgacatggtttggctatgtcaccacccaaatctcatcttgaattgtagtttccataatccccacatgtcatgggagggacctggtgggaggtaactgaatcatggtggcaggtacctccatgctgttctcatgatagtgagttctcaaaagatctgatggtttaataaggggcttttcttcctctttgctctgcacttctccttactgctgccatgtgaagaagggcatgtttgcttctccttctgccatgattgtaagtttcctgagggttccctagccaggctgaactgtgagtccattaaatctctttcctttataaattacacagtctcaggtatgtctttattagtagtgtgacaatggactaatacatacacatttagaacatatttcatctgaaccttaccataaattcctaaaggtagtgtgaacgggtcaacgggctcacagaatttaaggtgttttttttcttttttaatatcctgcttaatttgcccttgagcaagtttgaactaatttaatttgtcatagcagtgtattagagggaagtgttggctcttgtgtatagaatctggaaataattctaatgtgaagcagatctatttaaatctagctacaataatcacatgcttcagtaaaaatgtcacattaattcagatttcatatcaccgtgaattaattaaagagacatcagtattagtaaattttctgacttacttgcattgtagtagagtgattactgaacaccctgttcttaaagataaaagactgacgaagaaaattgctttgaagcagaaagagaacaggattcagagttaaaagacctgtgcaagtggggcaaatacattccttggaacttattgttattttatctgtaaataaagatgacagattgagcaatctcaaggcttttccagttctaaaacattccctgtatgctatattgcagtctccattaagctaatacccacgacctgttttcttgtttttttttcatagaacctagtgcataaactaacttgcaaaacagtcatttttatgtgctacacgctccacattacaatatatttttaaatgagcatgctaggctgcttattaatcagatttcatttcataggattgtacaaataaaatgataattgattttccagtattaattactctgtagcccttggcagatggaatcattcttccagttgcttgattttttagaaggtaaagagaaactagaaggtaaaggtaaactagttaattgaggtctcatgcaaagtttactaacagaaaaacatacctaaactaagaaacgattggttttattcagttagaagggagaggtgaagagggagttgacttgtaaccttgacccttatagataaccaagcattttaaatgtagcttttagcacatttttgtgacttttaagtataagttacatagtagaaagagaaaatatttctttttatttttatgccaattgcttaaattaatcaaaataaattatgtgccaggcacagtggctcacacctgtaatcccagcattttgggaggctgaggtgggcagaaagcctgaggtcaggagttcgagatcaacctggccaacatggtgaaaccccacctctactaaaactacacaaattagctaggcgtggtggcacatgcctgtagtccaagctactcaggaggttgagtcaggagaattgcttgaacatgggagggagaggttgcagtgagccaagatcgtgccactgctctccagcctgggagacagagtgagactccatctcaaaaataaataaataaaatatgaaaagtttgtcatctttatttaagacacatagttgccctgttttaacattattctatttttaattgtaaaagcaggtggagaggggtggggttcatgcctgtaatcccagaactttgggaggccaaggctggcaaattgcttgagccgaggagttcaagaccagtctgggaaacatggtgaaacctggtctctataaaaaaatacaaaaattagctgggtctggtggcacatgcctatagtcccaactacgcaggaggttgaggctgaggatggcttgagcccaggagtttgaggctgcagtgaggcaagatcatgctactgtattctagcctgggcaacagaaaaaaaagaatatgattataaccatcaattaagattcagctagtttaagcaaaataatcaaaatattaaaaaataacaaaaggtataaaataaaaagtaaaggctcccacaaattccagaactgaatattttatccacttctgttttgtttaaccatctgtttcttgtcacaatatctatttatttcctgctataaaaggtgagaaatatacatccaacatacacagagagattcaaaattttactggttatatttctggttttagtcttctgattggcactttataactgtaaatattttactaagaactttatttgttaattcttcaactccagagtatctattgtctgttctctaccaactctgcaaaaaatggtttgacctagctttttctttctctcaccactctttttccaccttttcttaactatacctttatttttacatttgtattcctccatggagattcctcttcttctatatttaattttgttgctgggtgcatggccagttaagatgtagaaatggggcatggaaagtatggaagtgatctatgctgattctatgttgggacacttaaacagtgatgtgccttctgcatgctttctctgccctgcttttgccagctgggaaatgagcgggacctagacccagcctaaagcacatgatgaaagtaacatgagtctataaatgaccctgtgatggagagccacccacagatctggaaaattctccagctgactcttttgtgcaggaaggatataaatgtctttgttctttaaatctaggaatttttggtctctgtgctttagcatcttcgcccaccctaaaaaacacatttccgtattttgcctacttttttattctacagtttcaaaaccacttagcaccatttacaacaataggcatataatagtgttatttatttcttaaccaaatagtgtggctggcccctgagagagcagttgtgatgctaggttaattctatgccacttggagaatgttccaagcatcaggtaaattccattttcttattcttatattcaatcagtagctcaacccatgctgtattttagtttgcatagcattttgagcatgatgttccacagatttttttttcacactgcttatgtgcctttctttattcttactgaggtgcttactatatgaacactagaccttccatacttctcatattctgctctatgtgcaaaatagatccagggttttatatttagataattaagatcttattcacccatataagttgcctttttaacattctttatgctggcatcataacgtagtttctgagaaggcttgctattctttgttcccacctcagcatacacttacttgcctttttttatgatgtagctctaacaataatacatagaaatgcattctgcttcccaatggtttcttttccttgttgtcatgtgtttgttcagattcatttgtgtcacttcttattttgatgtttctcttcctggctgttcattttcttcaaatatcttgtgattcttgattaaacattccaacttgatggcaataagtacctatggttgatttctttcacagttttgtaagtctatttaaccataaaagcctggttctatcaaaaggtaacgtttcccttaagatgtgtggttgagcaaggggccgactaactcacagccttcaaaaataacaagggtggagggcaatatactggtataaagtgcttttgtgtatttcactcctacatgggatttgctttattctgcttatctttcaattcagtattcacattctgggtcctccataagtacactttgattttcaattagaaattagtattctttacaccagctgaatgcaaatactacacatccaacatctttgagtatattagaagagaagaaactgctgcaactcactcaccattatctcttctactaactattctggttgcctccccacagctctcctcacctgctaatattctgtctcaagccagtggtttctatattcattttctcttaatcacaatttttccttggttttcctttctttgctctgggctgtcaattaagtcacatttactttgcagttgtaatagaaattactcagagacttgttcttaatcaggaaatttgagcttgtctgtctttattcaaacaaactattctacttgaaaactatgtagttatttttacgcaccattcttatatgtaatatttgtattataacatataactctgggcttatcctcattactgtaccctaagataatatatttcacaagtttatatccttacaatccttttgaataatgcagtttttgtgtaaggccataaccagctaaatcagaaaatggtattttctttcctctctccatccttctttttcttctttccttccttccaggaagacacagagttttgccatctttaatccctagtatttagcacaatatctggccaaaagtagaaagcatttttttaaaaaaaataattgatggaattattttatttcatttgagacagaatcttgttgtctctcccaggctgaagtgcagtggtgagatctcggctcactgcaacctctccctctcaggctcaagcaattctcatgcctcagtctcctgactaactgggactataggcctgtgccaccaaactcaggcaattttttgtattttcagtacagaatgggttttgccttgttgtccaggctggtcttgaactcctggcctcaagtgatctgctctcctcagcctctcaaagtgctgggattacaggtgtgagccactgtgcccccggcctgaatttttaaatgaatgagttaagtaatgaatactatgattgcactatacttagactttaatattttgtttcttcaaccttggaaaaaaaactttcaccctctaactgggtatatctcatttgtgataattttatttttttcaagaatatttattcagtgcctactctgtcctttgctctaggcatgtggaataaaagcataagaaaccaaaagaaatattaacttcttggaaaaattcatggcgaagggatcagaggaaaaagaagacaaatattacaccaataatgataaaattgtaatagagaattacaggtgatgaaggagagagtgaattaaacaggagggttggagaatgtccttctgaagaagtgacaattcagcaaagatctagatgagaaagccccatagaagatgggaaagtctattcgaggttagtgtaaaggcaaagtggaagagtaaggaggctagtgtgattgtacctcagtttgctcacatgattatatatatatatatatttttaagacagatgcggtcttgttctgtggcccaggctggagtgcagtgatgatcatagctcccttctgcctcgaaattctgggctcaagaaatcccccagcctcagcctcccaagtcactgggattacagatgtgagcctgtctggctcacatatctggctatgtgaacatattattttatactattctctgtaagagtttatgaactttgcctttcttaactttccatttggctattatctaagtcttccataagttttttgaaggctcgatcatttcaatccttttcaccatccctggtaagtaataaacatatagtaacaagattaaatattacttgaaataatgaataaaagagctgattgtcaacctgatcaaattacgtgaattttaggcacatctacaggatatggttattcaaaatatggctcattcttataccaaagagaatacattaagcaagaatttcaaaactcggattcacttgtcacaccgcataaatgaaagaggaagaaatatgtactcctgaattactgatcacaagatatttcaaagatttttgaaggttttgaaacacttgcaagtatgaatgtggaataaagttaatttgccttcccactgcaacttgcccttatacctgaatttcctctcacttattgaagccatttcatcctgctttcgctgcctgattttgctgtttgacattaggcaattaatggagtggttatgtatggtcatttctatctcaataaattctgctcattataaaactccaatacaagaattattattgacattgacaagtgcaaatattttggccttccttttgtcatcattaaatttggcaattacctttctccacagactgtacatttataaagaaagggaaaaagtaaataccaaggatgtttagtgcaatttattttcagatgagagaacaggccttgatagattcaatgctttcctgatggcttctaaagtagagaatgaaagagatgggatctttttcatagtaagtaattacttttattatagagtatttcacacacataaaagaataagcacaaaaatgatcccttgttaaatttctgttaaatacttaaaattgatttgaggaaattttcttgttttcctggtttacaaagaattacaagaatcataaatattcaatattgaattttgaatcataaatataatgttgagttttactgaatgcttttaattttttaaacatgaatcttttaatgtaaattgtgattcttgcattcttgaagtaaatataattagattatgatatatattgcctttttttttactacaatctactgatgtatccttttcagctgaagctcttttttgttcttttactttactgctctgtgtgttctatcgtctaagcttttctttggttatactagagagaacaacatacattcttatgttattaaagtctagttttaatcatatcagaacaatataaacacctttttgaccatgttcaccatccgtccaaattatatgcttttttttttttttttttgagctggagtctcactctgtagcccaggctggaaggcagtggttcgatcttggctcaatgcagcctctgcctcccagtttcccaggttcaagcgattctcccacctcagcctccccagtagctgggtataggtgcacaccaccatgcccagttaattctatatttttagtagagatgtggttttgtttgttatgttggccagattagtctcgacctcctggcctcaagcaatctgcccacctcagcctcccaaagtgctgagattacaggtgtgagctgccgcacccagtttatatgctatttttgattaggatttttgttatctattttttagtcattgttagaaattattacaattacttatgcacctaagatctgtttaattttgtttgccccagggcaacctggcttcattattttacctcctgtgtcaactgctgtttttttttttaatgtttttttggcctttgggaattttttatacttcttgtgatccctacaatatattctatgtgtatttgttgctgaaatacttttcaatatgtctagtctgccacactactggtctctcattcttttatgatagcacagctattataaactaaggttatgtatgtatcacagtaacttgtccattatctctgtcaactgtgagatggaggtcacaacgtgctttctataaagaaagggcaataaagagtcaactaaatatcatgaacaattttatctgtatttttcatttccccttgacattttacacttattttatcacatgactttcaaagtctcggaaaaaatataaagaaaaagtaatgttatataaaatatggcactttaaaggtttataaataacaaataggcattttaaaattcttttcaagtatcttattataagtattttgtaaaaagtatagaaaacggcaggcaaactcactagctcattaaaatagcttcagtgtcattttctaatcttcttgccttgtcatttgatttactttggctcttaatatctattcacttatagattagttcatcaaaatcatatgtatacatgtatgtatatacatgtatatgtatataattttgtgcacacatggcataaacctcaaacgtcatgactaaattaaattaaattaaattatatccattcactgctgtacttttgtctgcagaactgaaagagacagaggattccttagaaccgaattaaaaattcaagaccacctgcatcaaaaacatgtgggagaaagcacataactggaaaagcatgtcacagagaactgtaagcctgctctgccaagctgaaattctaaaatagaaaattaaatattgaaacataaccttgaaatacacagccattgtacattcaaaagccatgagagccattatttctgaaacaccacgtgaaattaaccatttattttacactccacaatatagactacatcaaatttatctgaatactattagaaagtacaattttcagacattaaaggaagaagtttttctttttttttttttgcaagagctgtaagatctacggataaagaaagtcatctttcaagtttttattccataagcttaaagaattatttacaaaatagtttttatattccttggcagaaaatcctttttgaaagtcatccatctttcctttttttcgtcttcatgacatttgcaagcaattgtacagagatttcctgtgtcacaaacttcataggaatcaaagattagaaaaatttccaggaacatgtacacacacacacacacacacacacgcacacagccttaagatattatattctagtatgtagtggctagtttcctacgaacttggatatctacaaataactaatttctaactaatcctaactggttataatcggttgaatgtgtgcatgtttgtgtgtgtgtttatattttaccaatcaggttgtaatgtctttggaacatttttgccattcctccatatttaaactgaaaatacctaaagaccatgtcaattacttcccaaaacagactgatcaactcctgtaaaattgatggcagctgtggcccatctggagtggctgctgcaaaagagctggctgcagtggggaggcatggccagggctgtgtattccctggagccggggggaaccaggaacaggcggaaggcctgtccccttaagagttggtgggccaggagccctgcactcccaggcacagctgcggacactgtgctcagaagtacctgctctcactgcctggcttctcctcgctcctggcacccactgtgatttccgagcaaagttgtggctgagcctgtgtcacaacctggccagatgtgcatgcacttggggtgacactgacacatcagccccctgtcacctcagccccctccagattttgggtgccaatgagcacggcagggaagccaaggggccactgaggatggctcggcataggcccgcaggtgcccctttgcatgaacagctaaaaacccgagactcagtcagactcaggcagatgacggggtgactgcctgtggagaagaactacccactgtggatctcctctccactgagagctgcaaatatcaggatgatctgactgtggagaggagctatccactgtaagtctcttcttagctgagagttgagcagattttgggacaacctgccagtagataggagctaccccgtttgggtgtcctgagagctgtactgtcactcaatagagcacctcttcaccttactcaccctccagttatctgcacacctcattcttcccagatacgggccaagaactcaggaccagcttaagcaacaacagtaggacacaattttatagcggagtgtgggggcagaagatgtaccattttaattttttatatattagcaatttattaaaaattaattagcatttcacaagcaatgcaattatttagaaataaagctaagttcagagtcctacttattacacagaaatctgcaagagaatgtcacccctatcaaacagaataaaaagccttttaatctaaaacactatgtatcttttatgttaattccataagttagctgagacttcaaagcaatatggtgaaattaattccagagagtgacaagatccttgaaggacacatgcattgtttcaccactgacagaggccaagaagaaagggtgatagacgtagagatgcataaaaagaaaacaacagatacatttttaaaattcttaaaggtgaagtgtggtcggggtaacagtttagtctggagaactaagagtcaccagctcttctccacccctctctgaaggtgctgacaagaaataatgtgggcaggcaagtgattgagaggcctccctcctccaggtgacgtgagcatacccccagtgattggcttttgctgggaatcaaatacaaattttgcatagattcttcacacagagcaaagctgtctgttgctggagaagggacaggaaaacctctcctgcctgcatcctgcaatgaaacaaagcagttttctgctgctagcaaagaggaggaaactccctctcacccaagatccaccaccattacaggtcagcatttgactgcctttgaggcagaggcacatagggcctggccaagggcctggctaagactgaggttatgacaggagagtaaagacaaggcccgggccccttgcagcatcccattgagtaacaagccacagcaaggtggctgttgggaaagggtatcctctggtacctttatcccagacaaaaccttcttgctattgaaggatgggcacaaatagctctaatgcccatggcattgccctgatacaaaacagatctgtttgcgtctggagaaggatcaggaacacagaaagagccccatccctgaagctcaggtgtacagaatctttctaagcctgaggatgcagcagaagatctgaaagcttccaccaccacctcaaaatccaccaaagccttgtctattaactatgccttttattttctgtgttttcatgctttgacatcttggggtcttgctaatgctggaggaagtattcctctcaggttagctaattcctagggacagcaaaatagttgtctgtgagcattcctatcaaacacaaaccaatgaatccagtctacactccaacaccttttttaactgagctttcatactctgtgccactatccacttaccctaatcacctcagggccaggtaacagacaactatgggtagcccatatcactcagaacctgcagaaattatttaaactagcccatcccaagcctgatgagcctcttacttcccctggaaaacacaatcaagtttcttgcccaccttttcttctcaccctctctcctcctggtctcccctaatgcttccctgtgtactgcctgtcccatggtacagtgggttcctttctctcgggattcgtgagtgcaacaaactaccttcccaatggcagtcagttcctaatctgttggccttgtgatgcctaaataataaaacctgcttttaaaaaaaccgtatgcccaggaaaatacaatagcagtcttctccccaaaggtgggaggcagcacagataaagccccctctgtgtcacaggcactccaggcgtgccgaaggaaaacagtggagcagaaacacagaaaaattcagtactccagacccaaccttaagcacaaaaaagctgcagcttaccactggaggaattttttttttaattaaatgttgaaatttgagataactgcagattcacttgtagatataaggcatagagatctcgtgtgtcctttcctcattttctctaaatggtaatgtcttgcaaaattacagtacaatattacaagcagaatattgacattgatatgatcaataaacagaccaacactgtcaccacaaaggtccttcatgctgccctttagtaatcatacacaattccctctgtctctcacttcctcctcaacctctggcaaacattcatctgttcttcatttctataattgtgtcttttcaaaaatgctatgtgcatccatgttgttgcatttattattgatccatccattttttatcactgaatactattctgtggtatagggctaccacagtgtccttaagcattcaccagttgaagactatctgggttgttttcagttttgggctattatgaatgaagtgcttttaaagatttgtgtataggcctttttctctttttatgagacagtctcatcctgtctcattaaaaaagacacaatcttcgctcactgaagccttgacctcctggctcaagtgatgctcctacctcagccttcccagtagctgggacttacaggtgcatgttaccacatctggctaatttaaaaaaaaattttgcagagttatggtctcatacaggcttttatatgaacatattttcattcctcccagagtgcatttgcctaggaatgcatttgctgagttatatagtagtgccatgtttagttttttaagaaatggccaaaatgttttccagagtgctgaaaaaccattttgaattcccaccagcagaggatgactgatacagtgtctccacaccctttccagtagttgatgtcgttaccaatttttgtttagctattctaatagctgaataatgatatctctttttggttttgattgcatttccctaatgggtaatgatgtttaatagctttccatgtgcttatttaccatctgaatattctcttcaggacaatatctgttcatgcctttggctcattttctaattagattgtttgttttgtttttacttcgaattttgcgagttcattatatattttacatgctagtcctgtgatttatatgtgttttccaagtatgttctcccactgtctacctttttcttcatttctcttaacagaatctatagaagaccacgagttttttattttgatgaagtccaatttatttttccttttatggattgcactttcaatatcaagtctaagaaatgtttgcctagcgttagttcccaaagattttcttttatgttacatttttttcacccaaaaactgttcagttttatgttttaaatataagaccacatccattttgtttaatttttctgaggtgcacaatttaggctcattttttttgttgttgttggctggtttatttatttaatggatgttcaattactcaagcacatttgtttaaaagggcatctttctaatattgagctcttgtccttttgtcagaaattatttaggcatatttttatgggtttattttagggttctctctgtcattgttgatctatgctttaatcctgcaaatatcacaggcttcattaatgtagcttgtatatagtaaggtcttaaaattgggtagacaaattcctcccactttattcttatttttctaaataattttggccattctagttcttttgcctttttagcatacgctttaaataaacttgtctatatctgccaaaaaaaattcctggcattttgattacagttacattaaaatctttatattattttagggagaactgccatctttgctatgtttagactcccaaccatgaattgtatattgatcaatttatttagattttattatatttccttcatcagatttttaaaaatttttttctttttgtaaagaacggggtctcactatgttgcccaagctggtcttgaactcctatgctaaagcgatcctcctacctctgccgccttaaatgttgggattacaggcgtgagtcactgtgcctggcagaattttttagttttcaccacacaagtcttgtacatattttgttagacttacatctaagtattttggggagttgtaaatgatattgtattttgaatttcattgtcaatatatagaaatacaattggctttgggatgtttatcttctatcctgcaaactttctaaactcagtaattctaagaagctgtttttggagattgctggaggttttcaaaataatcatgtcatctgtaaacagtggtagttttatttctttatttctgatataatttttttattttctttacttgtcttattgcactggctagaaattcaagcactatgttgaattgaaaaagggataatggacatctttctcttcttcccaatgtttgcagaaaagccttcttttaccattatgtagatgttaagctgtgggtattgtatagatgctctttgtcaagttgaggaaattcccttctttttctgttttatcagagaagttttgtttcttgttattttacaaatgggtgttggattttgtcagatacattttctgtacttgttaatataattatgaaatttttattttcatcccattaatatgaaagatcacactgattgattttctaatattgaactaacctcatatccctgcactaaaccataattggacatgacgtatcattttatgtattcctgaattctacactagggattttattacatctttcaaaatccttttgaaagtcatccatctttcctttttttggtcttcattttttcattgtgttcatgagggatgctggtctgtggttttccatatttttactctttggttctggtatcagggtaatacaagctttataatatgaattgctgagtattcccttcccttctattaattggtagagactgtgtagaattggtattaattcttctgtaaatttttgataaaattcctcagtgaaaccatgtgtgcctagggatttcttttttggaagatattaaattatcaatttagtttgcttaattcaaaatctaccttttgtgttttctagctacatgacatctacaggttactcagcatctctgtgagcttcagctgtattatttgcagtaattatgctattgaattcaaaagaatgtaatgaaagttaaatataataatgaatgtaaggtatttggtatatattaagtgctttattcgtgttttaaaatagcctttattatcaccagcactcttatcctttattcataaattcaggtaatagaagtagaaagggaatagataatatctcttggaagccactcagggaaggcctgggactaggcaagtctcaactcaagtaggtggacagtgataggcagaagtaagaaaaggtactcatctgctttgggcaaaatgaatcttttttttctaatctttctgtaaatgacaaccctggttccctgaaatatcttcatacctacagtaaaaataagctggcagagaatcaagtgaaaagaggaacactaaaccaaacaaaaaaatatctgttgagcaaagtttgaagattattttgcaaacgtaagttaaaatatgttttgcttgcttaatatagttacacttcatctttttgcataatcttttaggaaaagacaccatatctacagtatgattattatcccctgacattttttctattcaaatacttccatttcaatccacttgaagaaatgtatctcataatactagtcccataaaaggaaattctataggaaattactgctacttttaattcattgaattcgtcaattaatgaacatacagattaactctataaaaatgctcttttggcagaaagactaatatttgagttaaatagagaagaaaaacacaggtatgtgaagatatacacagacaaaaaaagtcgtctgaggcaaaatcaccaaatgagatttttgcaaaaagactgcccctaccaaacatatgcgtatgtaatacacattttagaggaaagaaggtaaacacaggagccacagacttcttagaatgcttaatgggtttaataacaattctacataaatattataatgacacttaagaaaaatactgacattattctcatagaagactattagaaatgcattctgtaagatagaaatgtcatgtaaaattgtttagattcagaaaagacaatggttgaattgctcccccgccaatcctgcctgattgggtcatgcattcctaccacagctaccccaagaaaacattcctgtcttttcccctacgcatctcagttaggacactctaaatgccatattgctcctttctatttcctgaaaggattgaagatgctttgccttctgtctgctttgtattctatgcctaggctcctgagcctcaggatcttcagctgttagaaatcagggatgactacatactttttaaagtatcactcaaatattttctgtaattaatactcaacagtttttatgatgataatcaataatgcttgccaggaggagaaggatgtacataaacctctctgtgtttatgaagagtatatgcataagctgacagaaaaattgtgatgaaattaactatctctatgagaaattatcctattacatctgtgatggttggttttgtatgtcaacttggctggccatggaatacccagattaagcgttatttttgggtgtctctgtgggggagttttggtatgagattagcatctaaatctgtggactcaataaagtagattgccaccccactgtaagtgagcattacccaatccactgagggcctgagtaagacagaaggtacaggaagaaagaacttgcttctttttgcttcctgcctgcctgactgagctcatcttattttctccagccctcagataggaattcaccaactactccactagttcttagacattcagacttggactgaattactccatcagctttcctgggtcaacagcttgcagaaagcacattgtgagacttctcagcctctacaatcttgtaaatcattcttcacaataaatctgttctgtttctctgaagaaccctcactaacacagattttggaaccaagagtggttctagaggaacgtaattttaaagataagttttcaaaattggttctggagtttctagaattgattctgtatttgataatatttcaagacactaataactctattctcaggagtaaagggagcactgatagactagggcctaaaatttttatggagatatagaaaatatctgcattggatactcctaatcaactacttacaagaagtaaagagctagatacctctgtataaaatacttttgaagattttcagaaaactaactaataaaatgacactggttggttgttcctgatgttgctgatcaagtggtaaaagaaaaacataagctaaggatttgaattcccagctcaagtgctgcataaatgacttaggagcttccatgtatgccctgaagtatagccttatctcctagagctgcaggactgaaattgtcaaaaatccaaagcagagcattatcttgcaactggctgaattacaaagcaagttgagctttcggtctggcaggaggtctacagttaaaatgaaggcatttaattgaaaaagaatgggatcctctaagttggaaagggaacacgtgggatagatcctgatgaagctgtggacattgagcctctaagttctgatgagtcttcattaccagtaaaagagatctccccaacctccagcagaattggcctcctctacccacagtgacagcagtattcccacccatagtggtactggcatctctgcctctatagttataaaagattggccttacattgcctaaggaaactgtaatgacctcccccaaggcagatgccatacaagacaatgctgattctctgcagaaccgactctttgcttctagacctataattagactcaagtctcatcagtctcctaaaggtgaggtacaatgtgtgacccatgaggaggtatgttaaactcaaacaaactacttgagtttttaatttatacagacagaaatctggagaacatgtacgaaattgataactaaggatgtgggataatggtggaaggaacttaatgttggatcaggctgaatttggcatggactcattaagcaaaggttctgcattaaatgttgcagcttgtggagtttgattctaacaggttggttggttaactgctgagatatggaccaaaaggtagtccggcatgagaaagttgaaaatacttggcatgccttattgcaatgtagaagaaatacaaaggcttagggatatattgtaatgttagggtagatttgtcatttaaggcctacttacccatagtgggagagtccagaaggcatacctttcaccaatactgtgaataataaatttgtcagtggagccctgtcatccttaaagatctctgtgatcactgtctgtaggccagacctcagagtgggaactgtagtcactgcattgagaagcctaaaggcaattggagtaattggatcctggagtgggaggggccactcagtcaccacatacaaggtagagctggttacctggctactgtaatggacagtagagttaaagcagcaatcagaagagtctgatatgttgacctatggacctatggactaggcttactgattatggcatttctagacgtgaaatagaaaatctgtcaaattgttacttaatctgtacaaggggtcttttaaaagtttatttaaaagcatattatgaaaaactatgcatgaatttcaaaaatgtttgcaccaaaataaacttgtactaatgttatgacatgtcttaacaggatctaatttgaggcactaaggaggataagacatcagtttgaaaataacccttatctctaataggaattaattttgctctcaaaattaattctgctaaaatggaagtaagaacaaactccaaatttatggtaaagcttgggtggaagaatggtgaaatcactgatgctttacaaaaagttgatgggtgcaattcccagaataaaacagcagtttacaaacagataacttgctttaagaaggagcaagacaattttgacaacaaggcccacagtagaggaccatacacatcaatttttgatggaaaaatttatcttttgcattctctacttgaagaagatcaataattaacagcaaagacagtagccaacaccatagacacctcaattgtttcagcttacacaattctgcctaaaaaattaaagttgaacacactttccacttgattggtgccaaaactgttgtgcccagatcagctgcagaccagaccaaagctttcaatggaaattttaaacaagtgggatagagatactaaagcatctctttgaaaaattgtaatcagagatgaaacatggctttacccgcacaattctgaagacaaaagcataatcaaagcaatgaataccaagaggtggaagtggtccagtcaaagcaaaagtgaactgctcaaaagcaaagatcattgtaacagtctttggaatgctgaagatattttacttgtaaactttctagaaagtaaaaaaaaaaaaaaagtatttgcttattatgagaaatttttgagaaagttagccaaagcttttgcaaaaaatctcccagaaaagcttaaccagagagtccttctccaccatgacaatgttcctggtcattcctcttattaaataaaggcaattttgcaagaattttgataggaaatcattaatcatccaccttatagtcttgatttggctcctttgacatctttttgtttccaaaccttaaaaaaatctttaaaggcaaaattactcacttttctttaattaataatgcaaagagactatactgacatggctaaattctgaaaaccctcagtcttttaaggatggactaaatggttggtatcattgcttacaagtgcaacttgactggtggagtttatgttgaaaaataaagtcaatgtttttactttttactttttactttcatgtttttcatgatctttttgaagtcttcttgtgcaagcagcaaagttctaggtcaagtgaacaaaagtctcacctgagtcatggcccctcaatcatttcccatatttgagccagtttacaaacctagaactccttgaatgaaaggtagtccaggtcctcttgaggaaggaccccaatgcacttccaaaatattataatgttaatatttcttctagccttttcccaaaggacctatggcattttatcaggataattatactcaaggaaaccaaaataattcactcacaaatatacttctttgacatatttcaagatgcttatccagaagggctacaaatataaggataactgaaaagctgtctttcgtggaatatatttccacgaaatatatatccaaatctgcatggataaaatcaggctttttcagaggctctccttgtctggatctcagaaagttataacttagagtctgaaacctttaaaattctgaaaggaatatttaccatctatttattttttttttttcctgagggctgccatctgtgaggtttcatctacataataatgttggagcttgttctatcctgtagttcagtgagaggaagggagtagcatccagtggctttccttcttctctcccattgtttggtgagtgggagggagtggtgctcagtggctccttctcctgtttttcacagagcaggaaggagggttacagctattttactcccactgcccgcagcttggcaagttctgggttcttgtcccatgaccaagtggaataaggtacatggacaccggagagtgaataaggcagagtggaattttattgagcagcagaaagaaagctctcagcagggagaggggacccgaaatcaggttgctgtctgtgaggccgagtccacagttaaatgggcttagaatgggggaatgtgtgctgattggtccatgggtggtcttggaaagagcatcattcgattagttaaaagccataattcagaagggagcaatcaagagagagtgggtacgatggggatggaagttctcactctggtcttggactctatccggaactgtcagttgtgttttcaggatttaaactgtccttggcttgaagactgggtttttaccagggacctgtccctgtctgcctaggaatttgtctgtttcctatcgctatcaataagactacctttgttagtcaggcatcttctccctctcccataagctattttgcccgtataacctgtgttgccatgcttcaagctccacattattgctgtaaccacaagatgagtataaaagtgtccaccacctggccttttgagttcttatattttgtaaacctcctttacatgttgataaatttgtatactttccatcctgttaagctgacttttttcagttgatttttcagtgaatcattagagagcaaagggggagttttcccttggtccctacagtacactggggaaaagaaaataatcagacttttggggactgctggacactgactctaaattgacactaatcccaggacacccaaaacatcactttggcccaccagttataacaggacttatggttctcagtggaattttagctcaggttcatctcacagcaggtccagtgggtccccacacccatcctgtggttatttccccagttccagaatgcctaattgtaacagatatagtcagcagctccccacatttattccctgacctatggaatgagggctactattgtggcaaaggccaagtggaagacaatactaccgtcaatatctaggaaaatagtaaatcaaaagcaatactgcgtccctgagggattacagaaattagtgccatcatcaagaacttgcaaggtataagggtggcaattcccaccatatcctcattcaatttgtgtatctggctcatgcagaagacagatgaactttggagaatgatagtgcattattataaacttaatcaggtggttactccaattgaaacatcggtaccagatgtggttttaatgcttgagcaaattaaaacatctcctggtacctggtatagagctgttaatctgacaaaggcctttttctccatccctgtccataaagcccaccagaagctgtttgcatttagctggctaggccagaaatacattctcactgtcctacctcagggatagataaattccccactctgcctcataatttagttaacagggatcttgatcacctttcccttctagaagataccacagcattccattacattgatgacatcatgctaactggatgtaggaggcaagaattagcagctactctagatttattagtaaaacacttgtatttcagagggtaaaaagtaaatctgactaaaattcaagatcattctgtctcaatgggatttttagagctccagtggtgtggggaagttcaagatatcccttctaaggtgaagaaaaagttgttgcatttggctctccctacaactaagaaagcggtacctctaacgggcctatttggattttagaaggaacatagtcttcatttggatgtgttacctcagctcatttaatgaatgacctgaaaagctgctagttttaaatggggcccagaataacagaaggctttgcagcaagtacaggctgctgtgtgagctgccatgacaattgggccatatgaaccagcagattgggatggtgtgaggagcctttggtagaattctattggtgaagcacagtgtggacttttagtattttgatgcaagggcctgcatataattattctccttttcttttctttttttttttgacagagtctcactctgttgcccaggccagagtgcagtggcgccatcttggcttactatgacctacgcctcctgggttcaagtgattctcctgcctcagccttctgagtagctgggactacaggtgtacaccaccgcgcctggctaactttttgtgtttttagtagagatggggtttcaccattttagccaggatggtctcaatctcttgacctcatgatccgcccacctcggcctcccgaagtgctggaattacaggcgtgagccaccgcgctcggtctagtctccttttcaaaaacagctatggtcctgctactaggccccagtgtgatggttactaccgagtgtcaacttgattggattgaagggtacaaagtattaatcctgggtgtgtctgtgagggtgttgacaaaagaaattaacatttgagtcagtgtgctggggaaggtggatccacccttaatctggtgggtaaaatctaatcagctgtcagcaaatataaagcaggcagaaaaggagagactggcctagcttcccagacttgatctttctcccgtgctggatgctttctgccctcagacatcaggctccaagttcttcagatttggcactcaggctggctgtccttgctcctcagcttgcagacagcctattgtgggaccctgtgattgtataagttaatacttagtaaactcacctttttatatatgctatgcttgtctagaggtttggttctagagggagaaatgcttctatcaggagacccaatgtttctactgaactggaagttaagactgccaggccacttggacttttcatgcctttgaatcaacaggcaaagaattgagttacaatgttggcttagtattaccatggcccgtcaatggaaaactacaacaatcccaaccaggcagaaatagtaatggccccaatccttcaggaatggaggtgtgagtcaccccgccaggaaaagagccatgaccagttgaggtacatgttgaaagcaagagaatacagcatgagtagcagaagaaggtagctataaacaccacctaaaaccatgtgatcagctatagaaacaaggaaaaaaggactgtaatggtcataagtgtttcctccttactttgttatgaataagtgtatgtgcatgtgcatatatatatttgattccttcccttttttattcccttatcatgtggcataagacgtattaattctacatcataggacttaagttgcaggataccaaggagaagagtagacatcactccacgaactttacttccttttctgggaaaagaccagcgcattttcagttgtatgcaggatagttgcatcatgttaggcagaattatgatcttgttactgtctttgtttggagattaagaatggtttaaggggtgtgcatgggtgctcagctgacaaggagtggacatctgatggttagctttgtgtgtcaatttgactgggcatggggttcccaaattaaacatggtttctgagtgtgtctgtgaagatgtttccatatgagactagcatttgaattggtgaacttagtaaaatagattgccctccccaatgtgagtgggcatcatccagtctactcagagctttaatagaacaaaaggtgtaggatggaagaatttgtcccttttttttctgcctgcctgattgagctgggacatcttctctcattttctctagtcctgggactaacagttacactatcagttccccccgtctcaggattttgaactggatctgaattaattacaccaccatctttcctggatcgccagcttgtagaaggcacattgagggactttacaacctccataatcttattagcctattgctcataataaattagtttctctctctccccccgatatatgtatatgtgcatgtgtgtatctatatatacatgtatatatatacatatgtgtgtgtgtatatatatatacacacatatacacacatatatacatatacacacacacacacacacacacgcacacacatataccccacacatacacacacatacgtatatatgtttctggttttgttttcctggagagaaacacacaaatatatgctactggctcagtttttccagaagtccctgactaatatgtaatattacgattgctgtccaagtctgggaattgtcccacttatttatagtccttttaaattaagagtgggcttactttaacttttattacaaactataaagataattttaatcattgctaatcttgatttaatttccaatgattccaattattgccaccactaatactgatatcaaattttttaagtagtagttatgtctataattcacttttggctttctcatgttttcttttcttattaattttacaaaagcaatcatttttctggaaatgtccactgcaaacagtaggcaacagtgagtgttatagcatttaaattagtaggcccactaaaagctactcagcttaataaggtcagtagtatgttttctggcttctctcagactattttttgaagattttgcaagtattatttttaatttctgcaatgtctctgaagattttaaaaattttgttaacattcttgatataattcaatttataaaccaatgctgaattgaagtcttaccaaattatggtagatgaaattatcatcctattagaaatatttcaaatatacagaaaagtttagagaataaaaccatgaatagttgtgaacctaccacaaagatttaacaaatgttaaatgtttcattttcttcagttcatttataaaaatcaacataaaaatcacagatttactaaaatctgcacctacattcctcttaccttccctgaaaatagctacattcctgaaagtaaagtgtctcttcgccttgctaattttttatacgtttactgcatatttatatgttcacatagagaatgcttatttttctaatatttacataaatggttataaaagttttcaaaaacttatctcactcatacaattaaaaataattaaaaaatattagaaaacgatagtgctgtaataaacaaagcacgtaaggaaaatttggagtaggtgaactgggagtaggttgcagtttaaatagagatgtcaatgtaggccttttggtgtcatttgcacaaacttttttttttttccatttactcatttacttattttagagacaggatcttattatgttgtctaggctggtcttgaactcctggcctcaagcgatcctcctgcctcatcctctggagcagttgagcttataagtgtgagtcacagcaccagtcttgagcaaacaattaaaggagaagagagaaagtgatttattttcctcatctattattacattggtctgggtctccagatacaaggataaaaccctctttttccttagtgatgcttttatgttttaatccttgcatctaatactaatattattataccagttaattctatgtgagtgtgtttgtgtgtaagatgtaagaagtgtaaaaagtgattacaatgtaactaaacatctctcaccattattttacttttacctgtttatttttaattgtatgtttctcatttgtaaatttttggtcgattttaaagaatcaaatggctttctgtttcttcaacactgttagacactgtccctttcgggctgagttaggtatgtttgaatttattatgattgctttttaatgtaatttatttctgccacctgttgtgtatgcgttttggtctactaagatctttcctcgttcatttgattttcctctctggcttctgaggatagataaagctttctgtattttcttagtatttactatgggctttgaaaactgtgtataccatttttcaagttacttacccttatatgcttaatacaaataatcaatataattttcaacgaagtctaacgtagctcaatatctttattactgttctaaaagatacttagcatgctttattcaaaaatgaacatctcccttagtttctgtggaatcattatccagaattttagtactttcttttgaaacataaagaaattacttattattattatttataccactcaataactcatttcatttgtgagttatttcttcacattgacttcactttttgggtgtgtgtgtgtgtgtgtgtgtgtgtgtttagtaatttttttcattgagagcctatttgtactgaactttgtgactgcatgctttatttccctctattcctggactggttattatcaatttatagaattctattttacagttaatttgcttgacaattttggattatttttccattgtcttctgatgtctcttattgcatgggatatcttctatctttaaaaaacataggtaacatgttttttttctctagtcggttttaagatttttctccttatcctatatattttgcagtttcagcatgatagtctaagtatttattttctatgcttatatttttatctatttctccacaaacataaatacctatgtacgtatgtattattatttcgacctatttctgttaattcatccatccatcatttgtccatgcatgtctgtctttccaggtcagcactaggtgttcagttttaggtagaaaatgtgtgtcctctttcaattctagacaattcatggaaataatctttcaaatatcaactctcaacctccattctctttacttggcactcctaacagtcttattttgcctattttcaaactattgttggtatctgttaactgttcctttgttactttaacttcatctatgctacttttggggaataatcctctactctctttcaatccactaatctctttgattgtttccaatataggcatttttcccatctaatgaggttacagcacctcaatgactatattttcttagatttgtctcttttcaagtacacctgttatttttttcatttctgtttaattcattatttcttattgctgttatctatttatatgttttctttcctacctctcataatgtttagtcattatataattattaattctggtcttagagctgatttttattgtctgattttcattcaattggttttattagttattgtgctttgatgttttaggcacattttgagtagaagatgttcttctccttgtattattctcacttcttcctttatagaaattttttagttgtctccattcaatcctaaatccaactgccaaaaaacaaaatttatgttagtgaattgctatttccaggagtgcagcatagcgctatcactacacaactccaatggacccatttcattggactccaaagtgagtgatagcccagagaattgtgcaatatgccatctacacattgcaggctgctgccttaggggacaccattcaatagtgaaagtgggaataaacctgtgagtggattagtgtaagattctagctgcttctttctttttctctgtatatactgtcccaagcagcaggcacttcatttttaaagttcttttcattaactggttaaattcatcatagtacctggatctgacctttgaacctgcttctggtgtctcacttttcatggtttttttcagttgccatggatttaaagcaactgaagcttcagcctcttttatttgaacaaaaagcaaagtccaacatgtgtgcgtatttggctacatatattactttttattcctcccaatttttagtccatggagaagtctatcttaatctttagagaattttttttcctttttaaaatatctagtttatcaacatagtaaatgtttataataaaatgatatgaacttgcaattctatcttggcaagaatcccaaggaaattatgcttatgcttctttctggttctcaaattttccaagccaaaacttccatatagagtaattttaccaaaaatttagagaatttgagtctaaagtatatttcctttaattaaaatatattttatatttataataatattttagaaaatatcctagaccagttcaaatggtttcagattattctaactttgattctttttctaaaaattttcaagtaataatttcacgaatatttatatatattctaggatattaagattacagttcctcatattttactcagaaagtagttgagatcttttcttttataaatttacattacaaaatggcataaaattctttgcttcccgcgtcgtaggtttgcagagaagcttagtttctattcttgttatgactctagcttaatttgcagtcttcatgaagacctaactttcactcaaagtgctatgttgtgatgtttataaagatcaaaatatattcttcatccaattgatatttgaatggtttcaattaatactttcatatatttgttaggattattacctcacattgtactatatatacattatatggctatagagtctacaataaaattggtaaaaataatctgggtcttgtatacgtataaattaaaatttagttaagctcataacatttaatacctagctctttactgctagtgatgtaaatatgtaatttcaaattgagaaaatagtaaacataaatgggcaattaataattattctctattttgtaaaaatgtgaatagcatcgatattgttttagattttaacgtgaaaatatttaaaataaggcattgtactcatgttcttaactcatgtggcacctcctttatggatatatagtgtgtcttttatatttttctgtagtaccttgtaacagtcacatcttctttttctagacaatgaatatctgttatatttgcctatttggtattcataagctgccctccttttcctgataacatataaatttcctttaagaatccctgatgctgctattctcagatcattttgctccagaagtctcctttattacagggcaacagggataaatataacctaggcccagaaaattagagccagggcatttgttgtagggataagcaagtgtgctgagatgccaatttcaggactttccctgaaaaattaaaaacatgatagcctattctgccaagtttgcaaactagttgggtattcatctatcactgctggagtaatcctgttgtcagaaggagagacaaggaagttcttggagaaaaaaaaaataaaaagctgagagatgaagacaaattcctgagggcatgaaactatgcctgaagctgtaacagttctggtatttttcagttaagtctataaattccctccgtgtctctttctatagtagtcaattagagttttgtttctctctaactgcaggagttctacctcacacatataattgtctggtctttcctctgtttcacctactatattttaggtttcttgagaactgagatgatttcttattatctgttttatgcacagttcttatcctaatgaccaacttaaatttttaataaataaagaatgaataaatacacaaatttccatagatatattactgtagttattaagtaaaattatcattagataattttttgtataattctcagctcaatatattaagttggcagaaaataaacatggtttttctcctactctgtcccatgggaaatcattatgaagaattagaattcaaattagaaaaatagttattaactatggtgtcaaatcatattgattaaataagatcagtattgttgtgtttcacaagtgatataaaacgacgtagaaagagatagatttgaacatatagtcctggaaatagctcaacatgcatcctctcttctctgccacagaagctcttgctttcgatgatgatgtcatcaaccagacattttatggtagaataattttgagtattattgctctttaaagcatctccttttggggctttttaaatttgtttttgttctaaaaaattgtgtattatgaaaagcatgtcctcaaaatagctttaacaattttaatattttgtcatatttgtttatatttcatttgtggtcatttatattttggtgttattttaaagccaggaatagatatcatgatgtctcatcataaattctttaatacataactcctaggaatagagatgttctcttacaaagctaagatgtcattataatgactaaaataattgtcaaccatttacaatgtaatatccaacccatattctaatatcttcaattgtcataagaatgctctttagaggttcctcttttagatagacagaagtactgcaaattgttgttttattatagactaacaagtcttttgtaagtgatgtttatatgaacaaatagattagatgatcatttcctgaatgttccccaaaatactaatcccaaaggtgacaatatttgctctacagaaaatagcattatgaagcaaataagtttttacagtagaaaatcctatacaaaactaataaatacttagaaatatgaaaagggtaaacaaacttgcacattgaggtagttgtagaaaatatcccaaactattcaaaaatcacacattaatgcttcctaaatgttcatcatccttcactataactacgaagagtccaaatgaaatgtaataagataagattaactagaaaaaaagagagatttcactgtaaagagtttcaaggatagaataaggacactgaacttgaatctgtctttagtgaagaagttttgcacaagataaagacttgatggaaataataattgggtaaaaaatgaatgcagcagaagagattgcaaaaaaagaattaaaacacaggctgttacagtaacccaggtggaaactgatgagaatagaatgtttgcttttaattcataggtgtcatttggccagcagacgccaagaggctcttgatgaaacagtggaatgaacacactagggtataggtactccaagtccttatcttagatctgtaatcagctgtgtgaccttgtgtaactcaagaagtaggtctattcctcaactgaaaatagaggaatgaaatagatgacaactaaggtacagctctaaattcctactaattccagaataaccttgccacatcagccatcctccattatacttggagctgcttgaattttgcaaatattgtagaaataaaagcatttatttttaacagaggttaaagagaactctagaaacaaatcatgagaaagtgataactttaatgtaggttgagttttctcttagtattatctttacagctactgcattataaaacaagtttaaaaaagcaacatgtgatcagaatatctcaaaagaaattctatcccgaaatttaagaattctaactatattatttatatcaggcacttaatagtattttatatgtacagactgtgatttaatttacgatagttttaactactcacctggtagcacttggactcctgctatagtcctagtgctcctcaatctctagcatttcaggtcaaatatgaatagaggccatgttttcaaggttatgaaacatgggagtgaaacatgaaggagggaggaagtcatgaagttaaagacttcaagttcaagtgaagctaggaccaaggagtgtacagattatgtaggagatgtcaccatccccaagaacatggaggtcatattttaatagcatccatgtaagaaatgcagggcttttccaagagacatgtaagaaatttggagtcccctactaagtttttatgagtaaagaacgcataacactgggacaatattttttttttgccaaagtatttttcttaagttttaatatctttggcataattaacttgaatctctgcctgacaaacatctcaatcaaatgtgtataataattcagtgccaatggtgtagcagtggcttagaccataaaagtgcaaggaatggggaacattaaaaatggtgaatgtagttgttacctcaagaaaattgtagtcttgttgctctaaactacatgtataaaagtgagcaataggtcctttattcagcatcccctagcaatttttaggaatatcagggtgtttgcacaaacaagaaaaatatatttctgttgattttcaatctgaaactttcaggattgcatttacttccctgttttccactaaatctgatgcacaagcaaatcactgttaaacatgttcggattctgcattaactccttcaaatcagattcttcatttagtcctttaatttatctaagtttttcctggagacttgaaagaattcgtgcacgttgcaaacacgaattactttttatatttgggaattggcctgaaactaggaaatatgatccttaaagactaggctcagaggtcaatgacacaagcacccatggtgccattctcaagatgctacaatgatttggaaacaagtgacctattgtctagtttctaccaatctagtgaaacctagtcactcatggcaattaatctatacccagactgattggatcttggtttaaacttgactctcattgttattctcagccatgtttagactacaacattatgggatagctctctgacatttaaatataatgcaagccacaaatgtgttctgcaaatgtcaagttaaagctttgtagtagccatatcagaaacataaaaacataatattaattttaataatttattttattcaatataccccatatattaacagttcaaaatgtcatttatatttttaaaacactaaggaataaatttttcttactaagcctttctttttttttcttgagacagagtctcacactgtcatgcagcctgctgaagtgcagtggcacaatcttggcacgatcttggctcactacagcctccatttcccaggctcaagcgattcgtgtgtcccagcctctcaagtagctgggactacaggcatgcgccaccatgccaggctaccatttgtatttttggtagagatgctgtttcgccatgttggccaggctgatttcgaactcctggactcaagtgatctgcctgccttggcctcccaaagtggtgggattacaagtgtgagtcacggcgcccggcctacttacaaagtctttgacatgtgatgttcattttatatttatgggacatttcaatttggagtagccacctttcacctctatagccatgtgtggctagtggctaccatttgagacaatgaagttacagtttcagatgttttaaacagtccaagcagagcaccatgagcttgaagattattaaaatgctctttgattttgatggtataactaaaaagtggcattctggaagctcagaatagatctcgctgaaatacgccagatttctcaatatttatgagcataatccctgtaaaaaattatctgtttatttattttagagatgtagtcttgctacgtcacctaggctggagtgcagtggtgtgattatagctcactgcagcttcaaacttccaggatcaagtgatcctcccacttcagtttcctgagtagccgggactacaggagaactccaccacacctggcctagtaacaggaagttttaataatactgaagttgctctcagttttaaattatttactcagaattacaaaataagaaagattacatgcttttaaacattggcttttctagatgaaaacccatgcttctcatgaaattcttattattcaaacgtgaaattattcaagttattcaacgtgaaattcttttcatatgatttgtaattattccaaatacataatcatggaaatggaaaaatgagtatatcatatcaacttcaggtgaaggtgataattcaaattacttatgtaattaattaaaacaatattctaatgtcagaattccctgagctgatcatatttatcctgtcactagagttttaaaaattgggctatcccttattttgaggtaagtaaatatatatatgtaacataaatatatatatgtatatatacacacacacacaaccatttttaagggtacagttatgtgatattaagtatattcacattattgtctaaccatcagcactatgtatctttagaacttttttattttccccaactgaaacctctttactcatcaaactaactccctctcttccactccttctcagccctagcaaccaccattctacctgtgtttctgcgaatttgacgactctaggtatctcgtgtatgtggaatcatacatttgtattttcgagaactggcttgtttcacttagcataaggtcatcaagcttcattcatgttgtagtatgtgtcaaaatttccttcttttttaaggctaatatttctttacatgtataagctacattttgtttatcaaatcatgcttctatggacacgtgggttgcttttggagcttttagttattatgaataatgctgctttgaacataatttccaaatatctgtttgagtcatgggctttcacttttattacctgtctttagtttggggcccagttatttttcatgcttttgtctcattaaaatggtattgaagttttctttcactttagaatgaaataaaataaagccattttgtgtgtgtgtgtgtgtcttgatagtatttatagtccttcttcctaatagaacagatacattcactcacgtggacatttaaattttttctgccccttattttctagttctgattccaccatattttctaaagtcattcttctttaatattaaaccacttcacctgtagaaatatcagcatactgaattccaaaaattaaaaatgtctctagaatattctaagctacagctcccagggtcccagataaattatcccagtgtcacattttctgtcagaatttatcttgtcaaatatcccaggcttcaatctttcaaccctcttcactctattaattcttctcttagctcccacacgtgaactattcttggtattaaaaactcatttttaaagcaatacaatttcaacaactaaaataccatgtgtgcttgattagggtaaatttagccctatgaaactgcaccttagcaattttgcagcatcagttaagtgcttcctctatctccaattcccttttattcccaatccacaactcactttccattgtgattccttcccctctagtaaatatgactttgagaacacatgatccaaaccaaggaaaaacaaataaaaacagtgaagcaacaaatacgatctaaaaataggagagcaaagctcttaaaatcctgagaaaaagtagacttttctctaactttttcaatgccatatttggaatgttcaaagatgtgtgagaggaattcagtaattttattaataaccagaactattcaaaggaccttcaccacctgaatttctaacactcggcgttccttgctttaagctatttttatttgcaagtcttagaaaaaaaggaagagatatatagataagcagtagtaaataatgcaacatttaatttttacttcaacttcaataaataaactactctcctatttagtatacctatgaggattgctcttgggaatgtcaagcaaccacataaatgagtaccaatgagagagataacatggaaacaaagtaatctgcagcacaacctcaggctagcggagtgtgcctgagagccaccagaattgatggctgtggagccctttagcagccaccagatattttctccccagagaacatttctctcctctttcttatctaacctttttgcttcaccttgtattacctttgtctcttgtagactgtatatagctgtatgttatttttaactcaaaattaaactgtatgccatttaatagaaaaattacatatatttatatttattgtaataacttactcctgtcatcttgctttatgcttttaagctgttttgttttatatgttttgtgatatataatgttttctttcattgaatcttttactctagtgattttttaaaatccttcattaacttcagtagttatgatccatttgttatattatttacacattttcattggtgttatctgaaaactaagaaatgaaattatttgcttgtgtttttatattatgtgtttgcttttgatgaacaattttgaaaatttctattctatcgccatattttaaacaaatatttacaatgcattctatttatattcaattttagtaattgctattaatcttatattccatacgttttctcaattctgtattttagtttattttctagttgttggaagaccatagtgaacattacaattgattcctcaatatttattccacccaagatgggtaatccaagccaactagagactggttcaggcatggtgagtgacccaattctatttaatgggatataaaaggatatccttcagagagcttccagaaaaagtgtcttctctcttaagatataaccacaagaaaagttggctcttttctttctctggacattggctacgaccattacaaccactttattaccagagtgaggtcaaaccagtaccaagaacagcaaaataaagtgatggaaaaaaatgggatttttaaaatgataacactgagctgtttttatcaagcctgaagcctacattacctctcccttcttgctgtatgaaaaaacacagagatatgtattgtagtcactttgagtcaggaattctgttattgtggctgaaaacattctctacaataagaattttttaaattaattttttattaaaaatgagtaatcttcaagatcgaaagacttatataaatgtttgggtattggtatctgttacattcatttatgaatggaaatgtgattgagctaagaattctggactcatttcccactcaacattcaactgacaaacgttatttttctctgaaaattggttctgaagaggtaaattatgaaatctgaccaaatattcctcctttagattacttgcttaaggtgcttgtaaatgttttctttatccttcaaattctaaaatgttatgaacatactctaggtaactttattcatttaacccttttgatcaacagaattatgctcttcttcagctcagaaaagttttattctaatacataactaattaatatttgtgatctattccttttgctcttttattctggcattttaattacagcattttatagtttctctaacctccatatttcttcttttttctaatagttaatccttttcctgtcattctacattattacacatgaaatattacgaattgtgaatgaatacagaggggtataaacaggaaatggattgatatagaaagtaagaaaacatgttccactttgtttttatgtttattgaagtctccttgtttccatctttatagtggctgcttatctaactgtgagtgatggctgtcactattcactgtgggacaggtatcaaatgtcagcaatctcttctgtaagtaaagtctgcatccagcgcatcccattcacagaccctgatacggaaaatgtgtctccagctcatcctctcttgctcatcctaaattagtagagtccttgctcccaggtccccttacagcaggtctccctgttgattatggcacacacaaaatatctcaagtctggatatcttttggcaaatccatttaacctatggggaactcacacatccttgccatgccaaaagatgagatacaggttgccccatttctgccctctctttttgcagctattcattccacatgattatttttttctcttgcttacataggtgctatggcacattacctaagtctaaccagagatctgacaaagagttatgtgccttgttctcttctagccatcctgatctctaggagtggctctcttggtgaccccatcccctgggtttagtgttggggatagagaacttcaaaccacagaaccacccaccaagcgggttcagaactccctcttcctccctttgattatttccttattcaacagcagcacaaaaagaggtcatgaggaggtcacagactgtgtacaatcgtgataagaacacattgctgggaacacactgggggaaagcattccctggaccagatctgttgggtaccaggggatggataaaatataactgctcaggtgaaactgaaggaagaatatgcagcttttaaatgtaaatggctcacgctgcaagctgttataatactaggcattgctatattttatctctgtagagagtaaccacaaagtcctattctttcattaaaaattatctcaggtgggcacagtggctcacgtctgtaatcccagcactttgggaggacgaggcgggcagatcacttgaggtcaggagggcgagaccagcctggctaacatggtgaaatcccgtctctactaataaaaatacaaaaattagctggacatagtggcatggtcctgtagtcccagctactctggaggccgagacaggagaatcgcttgaatctttgaacctgggaggcagaggttgcagtgagcagagatcatgccactgcactccagcctgggtgacaagagtgaaactcagtctaaaaagaaaataaaaaagaaataaacctcatgttccttttcattctccacccagactgccaatttgctgtttgtttttctcaactcttctccatgttgaatcctggaagttattgaaacaatccttgatcattgcttttagtctctagttgttgttaggcaaaaggatttgcggctcctcatcagaatagcaagtgaataaagagcatggattatggaatcagaccagatttacacttctgactgcatgttataactgtgccacctctctaaatcttaattttcttggttgaaaaaaatagcaaaaacaatactatctcgtacatttgatgtaacgattaaatgagatgacgagagcaaaggatttaacatgattttttacatatgcacgaatttaattattccaataggatgatatctacattctgtcaacactttgtaatagcaaaaataaaaccacctgtgaaccaacatatgctgaaaataacattgactttctccaggtacccaacatatttatgtaatgttattcagggataagctggtgagtttgtgttctctgctgctagttggacacactaatataaaaacttgcagattattaacacagttttctgtatgtaagatgtttcttttcataatatgcattaatattttatctttttattttcctactttctaatcccttctaaagctcagatccagttccagtttttgagatttcaggaaatagtctacactatattatataagggctaatagtttcctgaagtccatctccaggttattttgattagaagatcatcttcctcggggatcttgactttcacttctgataatattgcgttatggttgcccctaacacatgcatatatctgactagatgttattgagatattttagttacttcttccactgagagtgcatcccattgtctgaggaatgttgtaaagttttaatttgtcaatcataatacatgtatagttacaccagaataagaattgattggcaagtgtctaggctcaaaatttggttttagtttgaaaacaacaaacaaaaaagatgaaatctagccagatgctatgatattttttaaaaaatcaaacaaaaccaaatagaaataaaaacataaaagcttctaaggtattgatgacgataaaaacaatcagaatggtaacaaagtaatttaaaaatgaagtaaacattgggttttgatttgtaaggttgtaaaaatttttctctttattgaggcatttcatatatatgcttctacagtaatttactcatttttagaatttgaataagagttaggtcttttaattaacatacatttttccttcttgccagggaaatgcatgttttcatctaaaataagcacaaatgacacaatgtttagattatattgtcaaaaccaattgtctacttagtgtctatttccatatccctgccacagatattgacaataatgatatagcgcaaagtgaagtctatttttaaatgcttcctattgaaacatattaaagcaaatgtacatgtgcatatagaagcacacaaattatggcatgatgctgacagcaagaatcaattctggtgacaaaaaaaaaaatcagtaggcgtttcatgtatctgccaagcctaattctgactttctctactaggtgctaatataagagaaagcaacccagataccaactgggaaaaactccagattttctcttgggtacacaaattatgacttttgctaggaaaccatgataataacaaaatcccagaagattataatgtgaattcttaagagccttatacctgtatatgctcactgaaggggtccccttaacaactaagatacatttatttcaaaaacatcaagggccattgaataatcctcctacaagtgaccattgaaagtagtttaaaggtattttccagaaatataaataaaatggctaagtcaagggaggtcgaatttctattctttattaattcagatacttaactctgcctcctctaatgcacacagttctagaatcttgaaccagcaggctctgatgggaatggcagcctgcaaacataaagggtgagtgataaatagccaggctgtgtggcccactgtgttccccagcggaaaggagaaacagcccactatacttctgcaggtaccctttcccttctgcttcctgccctattgccacagtatccaaaaattgggtaaaactctgagtagaggacatgaagaaaggaactatagaacagctacgacataatggaaacagaaatgaagcaatggctgtttggaaaagaaaaagaactgaagaatacaatcacctccagtcagattagtttatcagtcaggattctaaattcaacttttagttgtgaaatgcaagttttctagtgaggagaagggaatgaggataaaggcaataatatgttaattgtagctgaatctatatttggactgctgtatgctcaaaattctacatattaggggtggtaggatttgaggaggagagaaaaaacgatagagaggatggtgttatgtggaagcaccgaggtttgaagtctgatttaagtgtctactacacaaataggcatagctctgcaatctaagaatgaatatgatagcaaatatttagttattgattatggaactgagcgtatcaaatctttaggctatttgctctctcctctacacaactcctgtgtccaccttccacttcctgctggttttctcttagtctacgccctgtcctttccagatgccaatgattcattctcttttcatattctatttattttttccactctcttccattcatctaatacatacagagtacctagtgtgtataaccctgctggataattgggacatagggtccctgcatttaagatatatgtgttctttctggataaataaataactttccaagtatataacaatagtgagtaatgataataattgctggctgggtgtggtggctcacgactgtaatcccagcactttgggaggcagaggcgggtgaacgcttgagcccagaagttcaagaccagcctgggcaacaaagggaaaccccgtctttacaaaaaatacaaaaaaacattggccagtcatggtggcctatgcctgtggtcccagctattcgggaggctgaggtggaaggattacttgagcctgggaggcggaggttgcagtgagctgagatcacaccactgcactccagcatgggttacagagtgagacacagtctaaaaaatgtaaaaataaaataataataataattgctagtactacatccctatgacacacatatggtactataattacccacattttacgaatgaaaaatctgagacacagagatgaagaaacttgaacaaagttgtatggtttgtagagttaaaatttaaatctaggcagttaaattccaagcccatgttcttaatatctataccatatatctttaagagtcaaaaaaaagtatatgaagtaaacacactaggtaaaatattaaaactaatagaagggtcaaataaatggcatagccaagaaatgcaatgaattccagagaccaagattggaataggtataaatattcagagaggttttttaacagccaccctccgccccagcaaacacacaatccatattgtgttttgggttcttttagggagagagatttttgaataaaagagaaggtaaagaaaagagaggtagaaattacaatttttttatctctcttttttagtactggcatgagactagctcattgtagtaggaattacctagtaacattcaatcatctaatgatgctttatggctttaagccatacttggtcaccttttatataaataatatagatcctagatcaataaaaaaaccctctaaaccaaatttaaattcatgttttttaaaaacaccttttagaaaatactactcctttattattataataatatctaggcaatctcgtgttaaataaacttggaatttagtaatgttttttcattattttccaaattgcttgtgccatagtgtattgtttaaacgctatagtatggtgtgccaaatgctaaaatcctatgcaacccctggcaatggtattctgcagtgcctcttattacagtgcatgcaacaattttcttgggttgggcatttcaaatcattttaaactgcaaatataatcaggaaattgtgttttaccatttatagtttccaaataattaaagttttacattagctaggcttattgcaaacttcaaactatttcaaattaaatcaagaaaagtacaagaaaacagcaaatgctctaaatgtcattggatggatagttggggaatgtttcatgtaagcgtgttatatatgaaatgctatggaggataatgctccttccttgacatgtccattctgttgggtttaaggcaagaaactctgactatgttaacccaaaattaacatagtgtgttttctcagagacagaactttgaaaaattctgcagcacaatgtggctcggtaattaaatcaagctggacccagagaactgcattgggtccacagaagactttttgggccaaatttcatagttattatcttagaccaggctttttagaaacaacttaggtatatacagtaaatatactgaattgtctgtcctctctaggaacatgtttcaccagattccagaaaggtctatgctcctaccccataatcacttaatcacttagagataaaaaaaggtctattcacatttaagtcaataacatacctttgactaaaaagggtaaaatcttaaagttagaagagtttatttttgtatcgaagcatcttttatcccctaacaagtttctttctatatatgaagactatagctattttttctatttaccctaggtgacattgattcatttgacccatacttattgagtgcctattatatattaaatgccatgtttatacattggatacatatttgtgaataagtaaactatcttcagaaactaaagatgatgaacacaaataatttaaataggaaatacacaaatccaatcacattaactgtgttgaagaaaatgaacagggtattgatgtagataatatcagagaggaggaacttcaagtggccaagagaggtctcatagaggggctggcatttcagccgaaaactgaaaggtgaaaaggaagcttgggaaaaataaaaataaaaatatattcagaaaaagggagcagaatacgacaagactagtgtggctgatcgtagaaggcaaaagaaagtggttttcagatgggtttgaaaggtgggccagagaacatccacatacgtcttacaggacatgatagggattctgaatagtgctttatgtacatcaggacatcaagattttaggcaggggaatgacatagttggatttatatttttcaaggaatttattggcctctctgtgtggaggacatgttggagagagacatggagaagaggcaagaagaccaagaaggaggatcctgtggtagttcaggaaagactggtgactgagcttacagtgggaacagcataaattaagagaaatggtgaaattattttagatagttgacctgctggtagttggtatgttgagagtgaggacaagtcatcttggatgcattaaggttgagtcataactttattttcccccaaagttatggaatgatggtagcacaaattaaaaatgcaatagcctaagggagagacagagatgtatttaattttcagtttactttaatcgggcagaaagggattaaataatgcattttttaactgttaaatgtgtaattccagtgagccatccaattgaagatgtcaattagacagctgcttattcaaacctgaaattgagaggagaggtttgggttagaaatatacatttggaagtcattgtcacacatgtgatatttaaagctttggaacagatgatcacagaggaaatgaaagttaagttttaaaagggaacataatccaggaaccagccaagatttagaggtcaggtttagaaggaagactttaaaaaggagaatgaaaaggataatcagatatagggtaggaaagaagaaattatggatctagaagcgagacagttgaggatttgggggagaaatgattggttactaagtcaaataatttgaagagctcaggtaatgaagttaaaactattgaccattagaaccttagccttaatagttttagagattgttaagagcagaagccagacagctaagtagaacagggagtagatatgtttggtcaagctgttgttatatgacaggctattctacagtgtatttagaggttgatagaatcatagagaaaataagaattgtaggtgtgggtctacagaatagaggaaatccttgaaatcaatcaactttagagctagtgagttgatagaaggttaaatattaactacgaaataacagatcaaagtgttagtttcttccacaattgttctaacaaacacaaaattgcaaattaaagacttgaacttctgattatgacaatctatttctacttaccttgttctttcatctcagaaatcagagatgtcttcaaatatatttttctacataatatcttaattataattggataattcaatccattttcagctgaatttaccaagcatttaacccaatttacctattctattgtaaatagtacttttaaaaaaaatttaagaattacatatatgtctaattatctcatctcatacaattacaaagagtctcagatatctttgtatgttaaaagaaaattaagttaaaaaaactattcaaaatttgtaaagaaacagtgagatttctatataaaataaattaggtagggtatacaattaggcaaattaatggatacagtattgaaatatgtagataagctacaatatataattattaattgatttttaagacctatttctgcttaattactactttttatttctaaaaccagcagattaaaaatattttctcaatttaaaaatttgatctctgtggtaaaactaaacatagaatgtttttgctctgttagaaattagcctttggagagaaaacacagttattgtaacatattattcaaggtaaaaatcactaagacatagagaatttcagattttttttgctaatttctactgagagaactgtttgggaaaactgagagaactaattgaaagagttgactatccatgctttaaaatgtcagattttaaaatctatctctgcactaaagacatcattatttttgacactgggaaaaagaaaaaaacaatgtttagaatttgttaccccaaacaaaataacagcaattaaaaaacacagcaatgaaactgtgattgaaaacatcttagaagaaagtgaggctaaaggtattacatttttccctgcttctccatatactgcaggttacctaaaaggaattcatatagcttttaaaaataaaatgtaatttcatcagttgcccttgcctactaatctatattaacatgacctgtatcaccattgacttttcttttagctctatgtattcatctgttctcacggtgctaataaaaacatacctgagactggatcatttataaaagaaagaggtttaattgactcatagttccacatggctggggaagcctcacaatcatggcagaaggtgaatgagggtcaaagtcaagtcttacatggcagcaggcaagcgagcttgtgtaggggaactcccctttataaaaccatcagatctcatgagacttattcactattatgggaaagagcacaggaaagacccaccccccatgattcaattacctcacaccaggtccctcccaggacacatggtaactacggcagctacaattcaagatgagatttgggtggagacacagacaaaccatatcgctgcataaccttgttctcctcattttttttctctctaaacagtaattgataaattacgttttcacgttaaaaatataataattttgtttttgccttttagaatacttgttttgttctgtctggctttagaattgggtaaggacctagaacgtgtaagggagaaaaagtaggagagaaatagaaataagtgagaagacagactaagcaaaagagagagtgggagatagatcaaatttagatattttgtgaaatgaaattaccaagttatttttattcctaatcagcattcagaaagctacattatataatatagttgaaaaaataatcaagatcctgaaaaatgttttcattagcctagacttaaagaaatattggtaaagatttgctttgtcacagcacgtcacaacatattttctgagctgtgatccaaggtgagttacatgagaaattagaaaatgtgttgtttatgtacatttacccttttaaaaattattaagttgatctagtctttgtctttcaagatcatagtatatgaagttgtataaaatgtcatttagaggtctatttttattgattacaatgttacataattttagatttttttgattattgtaataatataatccatcccatattgaccagtaccaagaaaaatagctgatttgctggacacataaactgaagccaaactaacaaactaatatgtacctaaatccatatatacatatttatctcatatatgtgtgtatatatatatgtatgtgtatgtatatatatatatatatatatatatatatatatatatatatcacatgtactaggtaagcagagatatatagagcattaatttatcaatactgttgttctatatgtgttcctgagtggtgtgaaatgtctggcatgcaattggcttgaattgaggagctgcccttcagagcagggctgtcttctagatcactggtccccagactttttggcaccagggaccagtgtcatggaagataatttttccatggaccagggagtggggaaatggtttcggaataattcaagtgcattacgtttattgtgcactttattctattattatttcattgtaatatgtaatgaaataactatacaactcaccataatatagaatcagtgggagccctacgcttgttttcctgcaactggatggtcccattggggatgatgggagacagtgacagatatcggatattatattttcataaggagcacacaacctagtcccttgcatgtgcagtttacaatagggtttgtgctcccgtgacatctaataccaccctactctgacaggaggcgaggctcaggtggtaatgcaagcgatggcgagtggctgtaaatacagaggaaatttcactggctcacctgcctctcagcttttgctgtgcagcctggttcctaacaggccatggtaccagtacaggtcagtggcaggggtattgaggacccctgttttagatcaactaagctctccataaatacgttagaaaaagttcacaatttaagcaaatgatccaggcaatttttcccttccttaaaattaactctctatgcaaaacaaaactacaagtgagctcttacctctgtattatatcaacaaatgataaactattaggaggaggattgaaggaacacaaacacggaggtcccttgggctttctgactaattcttgtcatttttgtcaattgcattaactctccaaagttccctttgaccacttatgggattataacttcagcatttctccttactgctgctgcctgaggcagcctatttgattttgcctacatcgctctggggcttgcacgaagtagcagtgttaaacttgcagtgaaagtgagccaagcctttaagtgcctactcaaacaacttggctgacctcatcatccttcttcttactaacacctggaaatggattcggcctgggagaaatagatccttttcttcgtggaagcttctgcctataacttctaattattccgtgggactctcgatgctttcaaaatgagtccatattccccgtcaatcagaactatcttaaacctctcttaaaggaaacactttcaaaattatcctttcttggaccagttgattccaggaattaccatactttatattttgtcttagtcatatcaaacattttcacctttcatgaataatttgaacttaaagcagaatggggcttcctggtccctatattcattttctttctttctatttgcattcctgttggaaagcagttttgctagtttgtagtttgtttttattataatgatcacctaaaagataatatatcaagagccagtatagcagagtgactaagagcatggattctggaaacagtccatctgatttgaaccatgaccctgtagtttaagatccctttgaccttaggcaaataaattattgaacttctctgggctttaatttcctcatcggaaaaatggcaataataataataagtactggcttggtagagttgctatggagactaaatgtgttaacatagttaaaatttaggcataatgtgacctataataataagctctttataagtgttagatattatatttgccatctaagatatgctctgagtgatgataaatatcagcatgtaaacactgtttgtcttaaaaatgcactactgtgaatactctaaaatagcctagtgagccatcttttgctcttaggggtacatccatgaataatggctagccctgaaggtacgtgatgctaaaacaatggcattgccagttttaacattgtgggactcaggcagaatggagtcaaaagactaagaatggtctacaagaagaaagaaggaagggaaacagaagaaagaccacccaaccaataaacaagtgttttcacccatcctgtgtattctaggtgtatttttgattaccttctcatattatcatattatttgtggaatgtggactgtacagggactacctttaaaacattgtgtgaactaataaatagcatgagaacaactagataaggcattacccagaatttttgacctgtggaatggtcacacctgaatccaagtatgccactgaaagtttcagaagcctcttctgtggcatttaaactgaataatagagaggcctagagcatttgcggggcagaaagacagggagagagagagagagagacagacacagacagacagacagacagactaactacacggagaaatctcaacctctagcagtggacttgatggaagaaactactctttgaaaatgctgtttctactccaaagtcataactaacccatattatgtatgtttatcagatttatccctcaaagaaatttcttccaggaaatattgggtcaaggagactgttacagaataacttatcccttatttattgtgcattgtttatttttgaaatgtggagacgccttatggagaagaaagacttatggggggtatggtttagtttggtggtctacataatatctgggtaatctccacacagatcctgtgttgtagacaatgatgcataagtagcatagcttctgctacatgtcactaggcactgaaaactcaaaatatttgtcaggctattgagaaagttatagggaaagaaaatttgaacaagcagtagatagacaacagaaatatgaactccgaaatgaatgtgaaatgtgggaggctggaatgtcagcttcaaggtggcttatggaggaaaatctggagaaacttggggaaggtggcagcaccaatgttttgctgaggtctgtgtgatcagtagtttataaagtaaatcttcagtagtttagaaaatgccaagatacatatgcaagttcttaacaacctagacaagagcagataaaataaatgcaattttgtgatatactagaaagttttttaaaaggacattagagaggaaggcttaggaaaatggaaccaattgagactcagttaagagctggtgggagtaatatatagcctagtgccaagctctgcccgacaacataaatctctccaagatgtctgagcatccctgtgatttccattaattcaaagagaagcaagatgggaagtcagaggttactgacaaccaagaaaaaaaatgaaatagttgaagaggcaaagatcataaatcaactcatacgatgtgtcttattgaaagctgacatattggtagatgccttagacagttggaataagaatttccaatcctcaccttcacgggaaggggcgtaacaacatgggcaagctcatgaattcccctcaaaacgacaccccacctcctgctaccagtactatctgagagagtatttagtacatactagtaaattatacttctaaggaattacttcctagagttggacaaaatgtcatggtattggatttgcttgggttctggcagtaacatactactagagctcctatcttgcaatactctgagaaaagtgtaagcagtctaaagtttctgcattaacagatgaagacaaattctggacaaagactctcaagtcaccattattatttagtccatttctgggcatcagcgtccacattttcccacagtgattattgacataacactcagtagtctgaatgtaggacattatctgcatctgggcaaactgtgctgaagagcccctgaagttgccagaggagatcagagaagtgacacatgtggagccagaacttgcaaccagactaatgttgctaagcaagaatgtaagtcagaagtttatcaacaacctagaaaaaaaatagaaatggttcacgaggcaaagatcataaatcaactcagatgatgtgtcttattgaaagctgacaggtgggtggaagtgttagatggttggaatgagaatttccaatctttaccttcatgggtaggggtgcatcatgggcaagctcatgccattctcctcaaaaaggcgccccaccttctgctaccagtgctgtctgcaaattctaactactttttggtattgacccattattcattaccacttatggaagaaagtgtctgacatcttatcatgctccccttaaatgcctttgtgcctacttgtataatcagataaaagtcagaaagtaccatgagaaaattttcagatatctcagcctacaggctgtcgggaaaagaagtcacacacaaagtataagcttctttgacactggaaggttttagatacccaagcacttgaaagaatctgtgacagggaaactagaagggaggaggaaaagctctctcatgttttgcgaaatgtagactcaggaacagtggagcaatatgcaattctaggacacctggagttttatcagtgaacactttaggaatgtctgtttctccaagatggattctttgagggattgcgtgaagcaatccttatgttaatggtgttatttttaaattctgaactccatgcttgtttgatcatactgtagataaggtaacaagaggaaaattaacacagaactctatgattatggcagccaataggagaagaaaaaatccttcaagatgccttcactagaaagcagctttggaaaagacaaaacatattattaattgaggggtatcacagagtagtgcctcataagtggcttgtggctacagttattgctacttcggaaatacttcccagaaatgctgagagcaatgcctcatgtctttgaaaccaagggagggagaaggcactggatatcatctgatacctaggaagagagaaggctctagagatcactgggcagtatttctggccccagaaataaaaaatgtttaaggaccattatctttaattctggcacctgcaaagatgagtatggggaggagagtggaaagtaaaatgtgccctccaggaaggtttatgtaaaatgcatctgaccagtactttttaaaaaaaattgtatgtgttgatttttttcccattagaaacagctaatctgatattagtaagagagttttacagcagtcataccaaatcatatcctatgaataatcagaatctattctctctgttccatggatgctgtgggagtttgttcattacagacttcctctttgaattccttctaaccaaggcagagcttttaagagcccatttctagagaaataatttaataggcagaaatttcaaaaaaaataccatgactattctctaatatccatagtgaggctgtaaaccagaaatatttagcagaactttgtaaatatctggggaactctcctttcaaagtcaaagctgtagttactagcattttattcctttcctgatatcctaccccaaagctttcattttccactgacctcagttttggggtatgtttcaagagacaatggattgccttgattcagtaagaaactaacctgaaaaatattctagaagtttttcatcatttggcagctgcagtcactcaaaaagcaacacagcctgctctaaagacactatgacaccatgtgggatatcaatggcatgctggagtttcattcacttgcaagagttttcaaggcattttacaaaagaagttactgcagctagattagggccatttgacctcttgccccaaattatttatttttctatgttcattttataataaagtactgaaaataacttaatgataactaatatttgtaagaaaaactgtgtgcacacacatgcacatgtgtgtgcatgtgtgcatgtatgtgtgtgaatatctgtgtgttaagagacttagttttttaaaatgaaatggaagaattaagactatttttcatggctaggttctattaaacacagcaattacgtgaattccccttcattcttcctggataaatatagaaaagtgagtaaatctcctactttgaaaaagtagggcacaaataagatgtatctgagaacctagtcatagggcaaagggagaaaaataaacggtgagagaccaagacaaggagacttctgtgcacaaatctgaggatatatttacatggaccaaaaggcaacctgatggggaaatatgtattttgattaccttctggacactgataatgatgctaatggctactatatgctaatatttattgaaagataattctcaatgtttccttcatgtttctgtacatttcacaagcagaagcatctacagcctatgttccagactgtcattccaaggatgtttttgtagtggacaaccttgggagacagagattataactctcctttgagcaaaaagaagatgtgtttgttgtgctttataaaagactcagattccctaaatttggggatttcctcctgacacaactctctgcttgtgcagatgtgacctggcccttttcatgtttcccaataaaactaaagtagggggacagaaaaaaaacatgaggtacatgctgtttgctatgacataattaatacagttctttgtctcagagccaggagtctcatgtcttctcctagcatccgaggatctgcagcaggctatcttattacacagttattacagaaatatttcagaccttccacagtctgggcaatggtctttgttgtaaaatgcctttttgagtatcagaaaataatcattgctcctaacggatttgaagataaactacgcttatttacgttccaagaggtaaaagaagaaaatcagaccactataagcagaaggacatttctcacatagtctcaccaaagcaaattgcaaaattcaataaagaatatatctcggagaagccaagatatagaactatagaaaaagaaaagatagtagaacaataactcagtacatcctaataataacaacgaaagcaataattaacttacatatggtggtttgcagtttacaatgcatttccacacattattttatttgggtcttataacgacctttgaaatagtcttttttattttcttaattacaccgttgagaaaattaaagtttagaaaaggttacataagttgctgacggccaaaactaacaagttaaggaaataaacaattgatatagactcaagcaaactgaataaaaccaaaaacaaaaatcaagatttggccttaggatcacaatcttttgtcacaaattatttcctttctgttttaaatcttccacttgtcccctgtgaacatgtctttctctcctatgcagaagaacaaaatccctctatttacactgtttactttagttataatccttccactttgttttcatggtgaaattatataaagagtagcttacatgtgttctctctgtctttcctgttttccatccatttcatctattattgttttttaaaaaaatccatattaaaatcaccagtggcattctaaatgataaagactcgggatgcgttttggttattatctcaagttcaatctcattttttgaaaacatgtttcttctttggattgtggaatactttcaatcacttattctcttctttctttctggttacaatttctcagttgttttcatggagatctcatcttccaactgtcttataaataaatctttctagagtttcatctccatccttctctccttgctcaatctgcttccactaaaacatctcatctatgcccatgatttgataactactcacaatgcaaaggcacacccattctatatgtctggctctgatttctttcttgagctccagatatgtatttccaagtatcgaatttatatctcaatctgataacctgtgaacttaaggttcaatatgtccaaaatcaaaccactctactttccctctaaattatttctttttgttttcctttcctggattgggtgagccacactgacttacttctaaaagctgaaatgccccatccttcttccttagtctccatattcagttggtgattgaattcggttcattctgcctctagatactccctgtaacatgtgcttatctctctgttaacaatgccttaaccttcatggaaccccacatattcaataggctgccctagtaaaataatctcctaataggtttttagtctccttttcatcaaagatacaatttatttacttctttctgaaatttaaatcttacaattttgctatctccagaattaaaatcttcaatatcttcagatattttactacctccaaaattaatattgaagatattgatttatgtttatgtctttatgaagatttatgtttgtttttatgtttatgtttgtgtttttatgaagattgatttgttaataaataggttcttaatcatgtttcaggaataggaaaagctagactccaggatttggattttaacatctccacaaggaaaggggagaggggcttgacttcttctcaggagtgtattcatttcattgttaggcaatgttgatggataatattttatcaatggcatctaaagacccactttttgtgactattgctaaattcttcagccttaccttcagtgcttagactcatgcccatgtacacacatgcatgacatgcatgctcatacacaaatatgtctatacaccaacacacacatcaagttcttccctgatatgtaacagtcattcctgcttctccacatgctctgataactgcttggagtttcttttcttcccccacctctactcaatactttctattcaaattaaaaccccattccactctcaacttctatccatatgcgcagagttaaaatctctccaagaatcttgcatacgtaacattcagagaatgcatttcattgctttgtcatcatttgccactggatctgtctctccgaacaggctgctgaataatgaatacagttaagttcctctagcttgtgtactctatttattatttactgtggcacttcctataataatgtggaaagtggtaactaaggaaacttggaaaattctagtgaatcacaacctgtaaaccatcactgagttaaggataaagtatcaacttaagatacataagccttagtgataatttttgttataaattgttataataatattactaacaaaaataagagctatcattttataggtagggattattatcttcagtataaactgaggggatgaaatgaaagtataaagaaattgtgatgacttggctaatgtcccaaggtaaatggtaggttctattttactcctgtgataatggccaaattagtagttttcaccaaatagctcagttctcccctggcactgggcagatggaagaaatgctactcccttgaagttaaatatggtcatgtgaattgcttaggccaaagaaatattagcgtatcacttgcagggagaaggtatcagagccagcacacagtcacgagtgctctctctctctctctttctctctctgtcacagcaactgccaatttttaaagctcatggctgctccatctgactgggacttcactgtagacaatgtgagatgaaaccacttgctgactcagattggaaatgtaatatgagcaaaaaatgaacttctgttgtgttagcccactaagacttcgtacatttttcagacatggcatgatttggctcactttgaccaacattccacagatgccattacttcagtatcaatgtttgcttgaccataaattggactcaaatggattttttggggggaggtcaagtctgaaaagagcttacccaaagttttgcatctttagggtacgaaaattatgggagtttagacgttcatagttacttttttcttttactattgcaaaacttaggtattgaaagatttaagacatatggacacagagaagccaccaacaggaaattgtgtctgaagcagtacaacaaataggaaccagagccagagatgaggcaaaagaatatatgaagccaacatatattctagaaatataatctgggtcagagccaggaactgctgagttaatcagtgtgaatcagaagaaagagtcagaaatgagagacatgcactacctaaaacagttgcagattcaagtttcagaccaagtgtcagggtaaagtcaagacatttctggtaagtcaaaacatttcagataagtgttttaactgaaaaggcttaaatattttaaaagtccacatttcatattcaactgcctcagccaccactatcacaatcctaattataacagtaatatattaaattccaagcacttcacatacatttccatatttaatcagcaaggcaactccatgaggaaactgaagtatacatcacagcactagccttcaaacccagttttgtctgacatcaaattatgtgttctcagacactgcgaaatggccctgtgccatttatccttctgtctcatacaaagagggtaattatcaataagtggctgggcttcccaaaatagagccaatctaacacagggctcaggacagaagtaaaagctaatctcagcatgacaaacgggcaagagggctagcgtgtgatctaaatttgcctaaaaataaattgactacacacctgtgaggaggtcaagtctctctctctctcccctttcaggaccgagatatcgtattatctgaatcctggattctagcttttcctattttggaaacatgactaagaacctgtttattaacatatcaatcttcatgaaaaacataaacaaattattcctgttttgacctttgttatcacttattgtgccacagttctggtccagctactctgccataaacagcaataatttgtctccctctgaggcttactgcgaggattaaatgagttaacacttgtatactatttacagtaaggcactgaaaatccattatttagtatgacgctgattatagtctcattaaatcctacaacaagattttgaggtgggattctactttttcaagtgagaaagctgaggctcaggtagtttatgttacattacgaaggccataccactaataagtagaaaacagggctgggattccacaccgtcaaatatttgcctgcaaaaccaaagctctttccactaagtcacaccacatgcctcactgcaatggaagaaactgcacaccaggtccaaacattatgcacattcgtccttattgaaaagaacaaattcactgtaattttgcaactcctcacaatgccagctgctataaactgtatgaaatttatgaaagtttggaaaggttcccaccataataacatagtatttttcgaaaataatttgcatgctatataacacacattatatatagcaaataaaaagctaaccctaagtgacaatacgtgggcagataatgaatcatttggaaatatcacgtagatttcacatagaaaatattgttatccatgaaaagcccaggagtttcttaaccctttgctgtgacgtggaaccacagcagaaagcaccgacagaccaataatgtgataagcttaattctctaaagggcaggagtgagagctttctatcctataacaacagtttggatgactttatatcaagagtgaggaagaaaattatactcctctcccacatatcaagggaaatgcttcccatggagtgactcagcctgaaaccctaaaccggagcacggtcacagcatgctgtaggcagtcacagcaggctccgtatcagctgccttcggcatttgtagggacaacacagagcggaggctgccaattacaccagaagcttctaccttgtgagaagagtctaatctagtggaagaaaaacagacactgactcttcatgctccaaactgtggctcttttctacttgatcatcaacaatatgttcaaacagccagaagaacacactccctctctagtaagataataattgtaaacagtcatatcactagcaatttgccaggcacggctctcattacttcatatatactaattcatacttcatatatactgattcattcaacttaatacttatagcactggacatatttttttccatataaaacacagatatattaagttacccaaagtcagatatctgaagtatggtaggatcagtatttaaacacaagctgtctggtatgctagatacctatccaagaatactgtgccagtatcaccctacttatccttaattatttttaagaaaagcctagcatttaggagaacaatcatagttacagggtgcattctggcaattgtggaggaaatgtaaaatcagataacttgagacaattatctttatggtattctctaggtccaacattgaatgatttggttttgctggaattggtgtcccatgagctcactcatcttgcccaatagttccacagccccaccttattccaagaaagcaaataaaatacttatttgatatataccaaatataatcttagcatgttgcaaatttaactttaaatcaataacttgattttttatacttctttaatgtacataaagaaattcttattaaaagatacaaatcaaactcaagaaagtgaatgcattgtatcatttttctaatagagtatggaggaatgtcacttaccaatactgcattgcaacatgaaaaatctaatctttaaagcccccgataaactgatcatgcatattgaacagcatgaaaaatgaatgacttctataatcttcaggatgatgtttgtttcctgttatattttggcactggcaatttattacacaagaataggttctaatcatgatattctttgcttcctaattattcaggaaagtccttggagcaggaaatctagcacttttcatgttgtctttgttatttaaaaatagcgtaataatcatggaattggcactatttctttaaaagtcacagctaatctgttaatttgtcttctcatagaatccattttaataatgctcttacactcagtgtgacatttcatactaccaatttactgaacaaccattgatctttgtctcagtatattatggattttatatttatgataatttttattaccacttgttttaggaattttcacaaatttattactgatttgtgtattcttatgatataattaaatgtacctccatattcattagccaatgaaatacaagtagcagcctataatacactgaagaatttagtagaaatgtctttcttctaatcaattcaaatggaatttctatatctgagcaatagcaattatgaataaaacattagctatcatagcaataatttatatattttatagtaatgtttcatataatacaggaacttttcttataagtacttaaacactggaaaatatattttaataaacaagccaaattcaacataacctaagccaaactcaatgctttctttacttgacagatatcaccataatcccttcttttaaaactggaggaaaatttcagatcactctctctcttcccctctctctctctctctgtcagttgttgtattttattattttccaagatatcctctgttaatttcaatattataaaatctgaatccccacttttccagtcgtctttcatgatctacgttatgcagtctacaccaataccctactaactagtctctagtctctagcatctttccatcaccatataccatcttctcagtcgtcaaagtaaacttctcgaagcataacattgcttctgtcactctaccacttataactgtacaatgacttcattgtttgactcaagtacggcatattttgatatgcttgcattcttacagacttcactcactcccttcaattgtgatgggctaaatgtgcctcacctcccttcctcaaatttatgccaaattttcctttttatccatatcatttcctttgtcatttaccttaaacctaatttttaaatatttgtttcaaatcctccctcttgtacgaagacttccctttccgttcctatctccaatggaattgtaaaaccccatataaccttaaagtctgcttgtatcacatacaatattctggctagacatagaattatttatctattagtttctagccttctttaaactataaattccttgaatggaggacacatatctcttcatatttgcatctcctgcagcaccaagcagaaaactcactctgaagaagatgctcagaaatatttacttaatgattggattaccacagcagcaaagagcagagcatatggaaatttgaaatcataggcaaatcaatttttaaccaatttagaaagtattgagtataagactgcaagtgataaagaagaagtaggccattctgaactaaattttctttactcttcttcttctttttttttttttttttttgacagggtctggctgtcagccatggtagagtgcagtggcacaatggctcactgcagcctcagcctcctgggctccagcaatcctctcacctcagcctgccaagtagctgggactacatgtgcatgccagcctgctgggctaattttttttttttccatagagacagggtctcactgttttgcccagtctagtcatgaactgctgggctcaagcaatccttctgcctacacctccaaaacctaaatgtaaatattcgtaatatgataaatgcatatattgtacattcagaggctctacacagttttgagtgtgagaaccataagttatgtcaaaatttccaaatatcatatattttgtaatcatatttttattattattgactcagtcaatagtcatagactttttttagttttttaaaatgcctatgaaattatagatttggaacttccttacaaatacccagcagcattctcataccctcattcaatccacagactaggaagcttctagaatacctttgaaactggtcttttcagataatatacatgaagcatttattagtgttcctggctcataatatgtactctataattaatgtgagtgatagtattcgctattaccatcacatctatcttcatgttctaagtccctatatgtgtttaacccttttctctgcttctactttataatatcatccaactaattcctgatacacatctcttatatcccacaacatctttctgcataagttgaccagatgccttaatttttacctcgttcactatcacgtgctgtttggttctttttctcctttccacttcttgcattttattctccctgtcaccatgttattctttccattcttatcattcttattgcattctctatatattgctttttctgtactcatcattttccaagtcttttggtgcctgctattaattagttgtttctttttctctcttcaacacctgacccaactgctgttcatatttatagttgaaagtcactttatgaaatagacatattcctgaaaatctagaataaaaacaaatttcttataaataaaatcttactctacatatgcaaagaaacaatattttctttttaaaacttacagtgaagtgaatgatcatagcctatcacttgtatcaatgcacacactaaaagagttgtgcggtcctaacttgaggtcctgacacctctttcttttacaacctctgattctaattccataatgtatctatgactccctgcttcctactctcttttaacacacacacacacacacacacacacacacacacacacacacacacctctcccttttccctccctcttgatatctatgagtcagaccatactgtctcaagcacagcattgcttttttctcctctttttccttccttctcactctctgcgcccgtttgtccttctccctgtctgttacagtattaccactctccattttgccaggctgtctcatcctctgctttatttctattacagctagagtgttttccaagcctaattgtgcacctaacattttagttcctttccttcaagatgtaatacttgatttaatttaccttttcctttctcttgtgtcaaaaaggtagtctcaagtcaacctgacttgtaaacacaaaaggcagagctggatctatccccatgaagaacaggatctatgatccattcttataaataaatgatactttgtctagcacaaatgtcaaataatctcataatatcaatatgaatacttacactcagcatatttctgaagttgggaaaattccgaagggctgaggtgggcccatttttcctggtttgtcatggtggtggtgagaagctctgtcacataccaggtaaaagattctttattcaggtgttgcgcagaggtctatgcttcaaagattccacatggcatgtttcatgataaaatacctcaggctttcaaaatatgcaatctgtccacatgaaactgctttggatgcttgtaatttcaataatgtgttaaagaa
